United States Patent
Ren et al.

(10) Patent No.: US 11,617,767 B2
(45) Date of Patent: Apr. 4, 2023

(54) ARMED DUAL CAR-T COMPOSITIONS AND METHODS FOR CANCER IMMUNOTHERAPY

(71) Applicant: Simcere Innovation, Inc., Cambridge, MA (US)

(72) Inventors: Shengjun Ren, Chestnut Hill, MA (US); Hanan Dahche, Wilmington, MA (US)

(73) Assignee: Simcere Innovation, Inc., Cambridge, MA (US)

( * ) Notice: Subject to any disclaimer, the term of this patent is extended or adjusted under 35 U.S.C. 154(b) by 0 days.

(21) Appl. No.: 17/531,635

(22) Filed: Nov. 19, 2021

(65) Prior Publication Data

US 2022/0160766 A1    May 26, 2022

Related U.S. Application Data

(60) Provisional application No. 63/243,486, filed on Sep. 13, 2021, provisional application No. 63/116,402, filed on Nov. 20, 2020.

(51) Int. Cl.
| | |
|---|---|
| *A61K 48/00* | (2006.01) |
| *C07K 16/28* | (2006.01) |
| *A61K 35/17* | (2015.01) |
| *A61P 35/00* | (2006.01) |
| *C07K 14/73* | (2006.01) |

(52) U.S. Cl.
CPC .............. *A61K 35/17* (2013.01); *A61P 35/00* (2018.01); *C07K 14/70514* (2013.01)

(58) Field of Classification Search
None
See application file for complete search history.

(56) References Cited

U.S. PATENT DOCUMENTS

| | | |
|---|---|---|
| 5,821,337 A | 10/1998 | Carter et al. |
| 6,407,213 B1 | 6/2002 | Carter et al. |
| 6,576,232 B1 | 6/2003 | Debinski et al. |
| 6,723,538 B2 | 4/2004 | Mack et al. |
| 7,060,808 B1 | 6/2006 | Goldstein et al. |
| 7,514,537 B2 | 4/2009 | Jensen |
| 7,635,472 B2 | 12/2009 | Kufer et al. |
| 7,902,338 B2 | 3/2011 | Hansen et al. |
| 8,324,353 B2 | 12/2012 | Jensen |
| 8,399,645 B2 | 3/2013 | Campana et al. |
| 8,497,118 B2 | 7/2013 | Jensen |
| 8,822,647 B2 | 9/2014 | Jensen |
| 9,212,229 B2 | 12/2015 | Schönfeld et al. |
| 9,217,025 B2 | 12/2015 | Jensen |
| 9,492,563 B2 | 11/2016 | Leuschner et al. |
| 9,605,049 B2 | 3/2017 | Campana et al. |
| 9,765,156 B2 | 9/2017 | June et al. |
| 9,815,908 B2 | 11/2017 | Schönfeld et al. |
| 9,834,590 B2 | 12/2017 | Campana et al. |
| 9,856,322 B2 | 1/2018 | Campana et al. |
| 10,035,856 B2 | 7/2018 | Cobbold |
| 10,124,023 B2 | 11/2018 | Brentjens et al. |
| 10,519,241 B2 | 12/2019 | Raum et al. |
| 10,556,969 B2 | 2/2020 | Schönfeld et al. |
| 10,696,749 B2 | 6/2020 | June et al. |
| 10,744,157 B2 * | 8/2020 | Sentman ................. A61P 35/00 |
| 11,219,644 B2 * | 1/2022 | Ahmed .................. C07K 16/32 |
| 2009/0252681 A1 | 10/2009 | Laeremans et al. |
| 2013/0280220 A1 | 10/2013 | Ahmed et al. |
| 2018/0021440 A1 | 1/2018 | Yu et al. |
| 2018/0085399 A1 * | 3/2018 | Ahmed .................. C07K 16/32 |
| 2018/0085400 A1 * | 3/2018 | Sentman ............ C07K 16/2833 |
| 2019/0083534 A1 | 3/2019 | Brentjens et al. |
| 2021/0038646 A1 * | 2/2021 | Maus .................. C07K 16/2818 |

FOREIGN PATENT DOCUMENTS

| | | |
|---|---|---|
| CN | 101321784 A | 12/2008 |
| CN | 100509850 C | 7/2009 |
| CN | 102209556 A | 10/2011 |
| CN | 105874061 A | 8/2016 |
| CN | 108289952 A | 7/2018 |
| CN | 111320694 A | 6/2020 |
| EP | 1798240 B1 | 4/2011 |
| WO | WO 2001/008660 A2 | 2/2001 |

(Continued)

OTHER PUBLICATIONS

Bi-specific T-cell engager—Wikipedia pp. 1-2; downloaded Apr. 8, 2022.*
Ross et al. 2017; Bispecific T cell engager (BiTE®) antibody constructs can mediate bystander tumor cell killing PLOS One pp. 1-24.*
Ngo, in The Protein Folding Problem and Tertiary Structure Prediction, Merz et al. (eds.), Birkhauser Boston: Boston, MA, pp. 433 and 492-495, 1994.*

(Continued)

*Primary Examiner* — Maria G Leavitt
(74) *Attorney, Agent, or Firm* — Hamilton, Brook, Smith & Reynolds, P.C.

(57) ABSTRACT

The disclosure provides, in various embodiments, polynucleotides and vectors comprising sequences encoding a mono-specific or a bi-specific CAR that is capable of binding to a first TAA, or a T-cell engager that is capable of binding to CD3 and a second TAA, or a combination thereof. The disclosure also provides, in various embodiments, T lymphocytes comprising one or more of the polynucleotides or vectors; compositions (e.g., pharmaceutical compositions) and kits comprising one or more of the T lymphocytes; methods of treating a cancer in mammalian subject (e.g., a human), and methods of inducing T cell-mediated cytolysis of cancer cells (e.g., solid tumor cells).

11 Claims, 118 Drawing Sheets
(117 of 118 Drawing Sheet(s) Filed in Color)
Specification includes a Sequence Listing.

(56) References Cited

FOREIGN PATENT DOCUMENTS

| | | |
|---|---|---|
| WO | 2005040220 A1 | 5/2005 |
| WO | 2005077982 A1 | 8/2005 |
| WO | 2006008096 A1 | 1/2006 |
| WO | 2007056061 A2 | 5/2007 |
| WO | 2008119565 A2 | 10/2008 |
| WO | 2009025846 A2 | 2/2009 |
| WO | 2012050374 A2 | 4/2012 |
| WO | 2012138997 A1 | 10/2012 |
| WO | 2013132044 A1 | 9/2013 |
| WO | 2013158856 A2 | 10/2013 |
| WO | 2014028560 A2 | 2/2014 |
| WO | 2014079000 A1 | 5/2014 |
| WO | 2014130657 A1 | 8/2014 |
| WO | 2014153002 A1 | 9/2014 |
| WO | 2014172584 A1 | 10/2014 |
| WO | 2014201021 A2 | 12/2014 |
| WO | 2015184403 A3 | 3/2015 |
| WO | 2015158636 A1 | 10/2015 |
| WO | 2015168474 A1 | 11/2015 |
| WO | 2016004875 A1 | 1/2016 |
| WO | 2016020309 A1 | 2/2016 |
| WO | 2016049641 A1 | 3/2016 |
| WO | 2016112870 A1 | 7/2016 |
| WO | 2016123122 A1 | 8/2016 |
| WO | 2016123143 A1 | 8/2016 |
| WO | 2016123675 A1 | 8/2016 |
| WO | 2016146894 A1 | 9/2016 |
| WO | 2016179003 A1 | 11/2016 |
| WO | 2016180982 A1 | 11/2016 |
| WO | 2017070395 A1 | 4/2017 |
| WO | 2017093410 A1 | 6/2017 |
| WO | 2017134301 A1 | 8/2017 |
| WO | 2017136829 A1 | 8/2017 |
| WO | 2017156178 A1 | 9/2017 |
| WO | 2017165464 A1 | 9/2017 |
| WO | 2017173321 A1 | 10/2017 |
| WO | 2017178572 A1 | 10/2017 |
| WO | 2017186928 A1 | 11/2017 |
| WO | 2018013918 A2 | 1/2018 |
| WO | 2018014260 A1 | 1/2018 |
| WO | 2018035141 A1 | 2/2018 |
| WO | 2018039333 A1 | 3/2018 |
| WO | 2018041827 A1 | 3/2018 |
| WO | 2018075820 A2 | 4/2018 |
| WO | 2018102606 A1 | 6/2018 |
| WO | 2018132494 A1 | 7/2018 |
| WO | 2018141910 A1 | 8/2018 |
| WO | WO 2018/191748 A1 | 10/2018 |
| WO | 2018197502 A1 | 11/2018 |
| WO | 2018204907 A1 | 11/2018 |
| WO | 2018226897 A1 | 12/2018 |
| WO | 2019075405 A1 | 4/2019 |
| WO | 2019118513 A1 | 6/2019 |
| WO | WO 2019/157533 * | 8/2019 |
| WO | WO 2019/157533 A1 | 8/2019 |
| WO | 2019175658 A1 | 9/2019 |
| WO | WO 2020/033837 A1 | 2/2020 |
| WO | WO 2020/176897 A1 | 9/2020 |
| WO | WO 2021/041725 A1 | 3/2021 |

OTHER PUBLICATIONS

Rudinger (in Peptide Hormones, Parsons (ed.), University Park Press: Baltimore, MD, pp. 1-7, 1976.*
Kimchi-Sarfaty C et al., A "silent" polymorphism in the MDR1 gene changes substrate specificity.Science. Jan. 26, 2007;315(5811): 525-8.*
Hegde et al. "Tandem CAR T cells targeting HER2 and IL13Rα2 mitigate tumor antigen escape", J Clin Invest. Aug. 1, 2016;126(8):3036-3052.
Gedeon et al. "An EGFRvIII-targeted bispecific T-cell engager overcomes limitations of the standard of care for glioblastoma", Expert Rev Clin Pharmacol Jul. 2013; 6(4): 375-386.
Hegde et al. "Combinational Targeting Offsets Antigen Escape and Enhances Effector Functions of Adoptively Transferred T Cells in Glioblastoma", Mol. Ther. Nov. 2013;21(11):2087-2101.
Bielamowicz et al. "Trivalent CAR T cells overcome interpatient antigenic variability in glioblastoma", Neuro Oncol. Mar. 27, 2018;20(4):506-518.
Choi et al. "CAR-T cells secreting BiTEs circumvent antigen escape without detectable toxicity" Nat Biotechnol 37, 1049-1058 (2019).
Fajardo et al. "Oncolytic Adenoviral Delivery of an EGFR-Targeting T-cell Engager Improves Antitumor Efficacy" Cancer Res. Apr. 15, 2017;77(8):2052-2063.
Migliorini et al. "CAR T-Cell Therapies in Glioblastoma: A First Look" Clin Cancer Res. Feb. 1, 2018;24(3):535-540.
Brown et al. "Clinical chimeric antigen receptor-T cell therapy: a new and promising treatment modality for glioblastoma" Clinical & Translational Immunology May 20, 2019;8(5):e1050:1-20.
Akhavan, D. et al., "CAR T cells for brain tumors: Lessons learned and road ahead," Immunological Reviews, vol. 290; 60-84 (2019).
Chanier, T. and Chames, P., "Nanobody Engineering: Toward Next Generation Immunotherapies and Immunoimages of Cancer," Antibodies, vol. 8; No. 13; 21 pages (2019).
Choi, B.D. et al., "CAR-T cells secreting BiTEs circumvent antigen escape without detectable toxicity," Nature Biotechnology, vol. 37; 1049-1058 (2019).
Harwood, S.L. et al., "ATTACK, a novel bispecific T cell-recruiting antibody with trivalent EGFR binding and monovalent CD3 binding for cancer immunotherapy," Oncoimmunology, vol. 7; No. 1;e1377874 14 page (2018).
Panch, S.R. et al., "Effect of Cryopreservation on Autologous Chimeric Antigen Receptor T Cell Characteristics," Molecular Therapy, vol. 27; No. 7; 1275-1285 (2019).
Slaney, C.Y. et al., "CARs versus BiTEs. A Comparison between T Cell-Redirection Strategies for Cancer Treatment," Cancer Discov, vol. 8; No. 8; 924-934 (2018).
Notification of Transmittal of The International Search Report and Written Opinion for International Application No. PCT/US2021/072533, entitled: "Armed Dual CAR-T Compositions and Methods For Cancer Immunotherapy," dated Apr. 25, 2022.

* cited by examiner

| Target or luciferase | Cell Lines | | | |
|---|---|---|---|---|
| | U87 KO | U87 | U373 | T98G |
| IL13Rα2 | <1% | 45% | 42% | 63% |
| HER2 | 1-2% | 1-2% | 90% | 30% |
| EGFR | 95% | 95% | 75% | 90% |
| Luciferase-GFP | 95% | 95% | 75% | NA |

FIG. 2

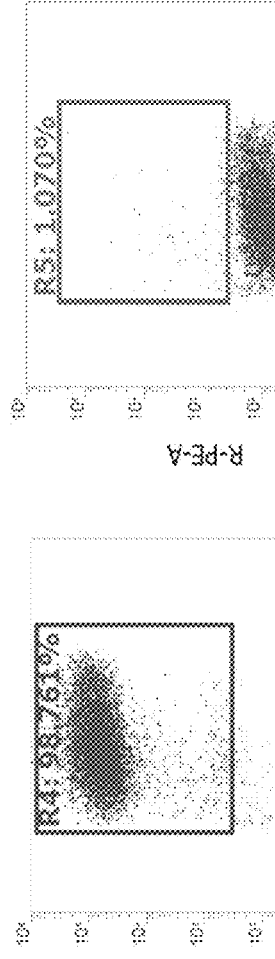
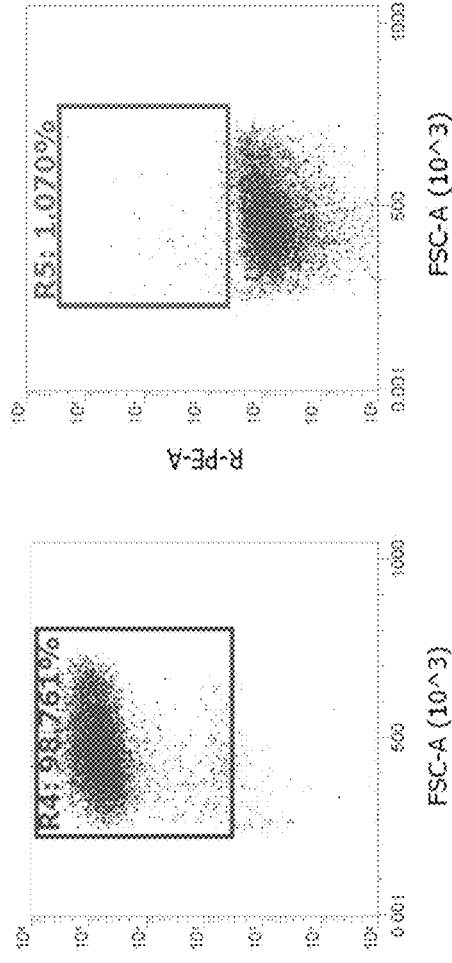
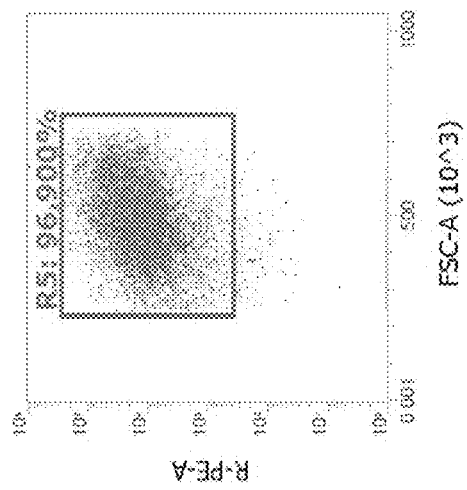
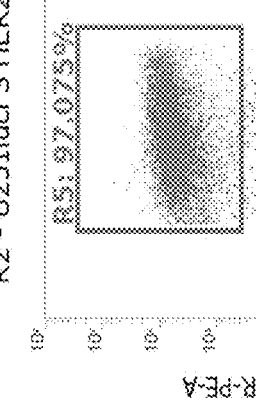
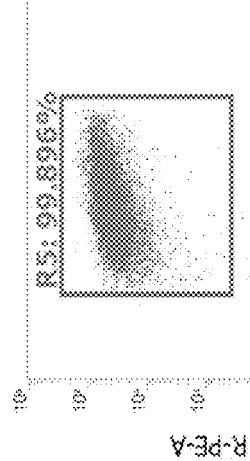
FIG. 31A

| TAA or GFP_Luci | (%) |
|---|---|
| EGFR (WT/vIII) | 99 |
| IL13Rα2 | 97 |
| HER2 | 97 |
| GFP_Luci | 98 |

FIG. 31B

Summary of Toxicology Results: Histology (HE Staining) & Blood Counts

| Original Tissue | Naive Control (#) | | | | SR26 (#) Day 2 | | | | | Un-treated (#) Day 2 | | | | | SR26 (#) Day 14 | | | | | Un-treated (#) Day 14 | | | |
|---|---|---|---|---|---|---|---|---|---|---|---|---|---|---|---|---|---|---|---|---|---|---|---|
| | 1 | 2 | 3 | 4 | 8 | 10 | 11 | 20 | 6 | 7 | 5 | 19 | 9 | 15 | 13 | 14 | 16 | 12 | 17 | 18 |
| Heat | N | N | N | N | N | N | N | N | N | N | N | N | N | N | N | N | N | N | N | N |
| Liver | N | N | N | N | N | N | N | N | N | N | N | N | N | N | N | N | N | N | N | N |
| Spleen | N | N | N | N | MF | N | N | N | N | N | N | N | N | MF | MF | MF | N | N | N | MF |
| Lung | N | N | N | N | N | N | N | N | N | N | N | N | N | N | N | N | N | N | N | N |
| Kidney | N | N | N | N | N | N | N | N | N | N | N | N | N | N | N | N | N | N | N | N |
| Brain | N | N | N | N | N | CD | N | N | N | N | N | N | N | N | N | N | T | U | N | T |
| Spinal Cord | N | N | N | N | N | N | N | N | N | N | N | N | N | N | N | N | N | N | N | N |
| Bone Marrow | N | N | N | N | N | N | N | N | N | N | N | N | N | N | N | N | N | N | N | N |
| Blood | N | N | N | N | N | N | N | N | N | N | N | N | N | N | N | N | N | N | N | N |

CD: cellular debris
N: normal
U: unilateral dysfunction
T: tumor

MF: hemorrhage or histiocytosis due to the procedure of harvesting tissue/organ

FIG. 45

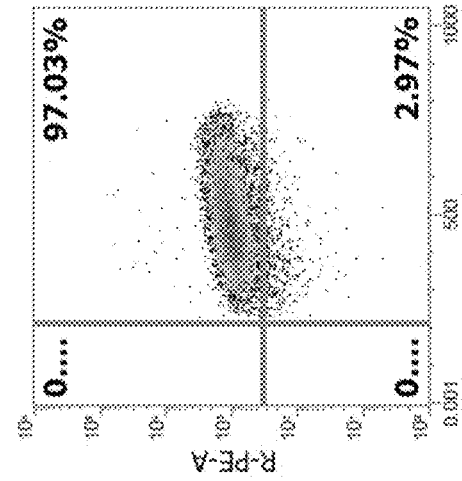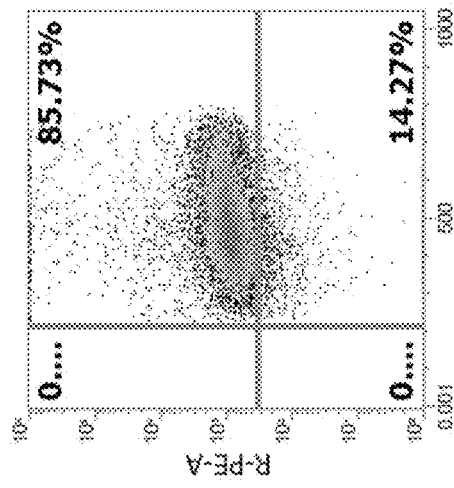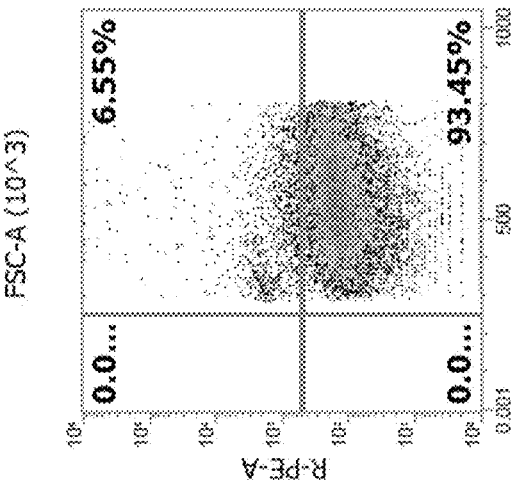
FIG. 52B

| (%) | 2nd Ab only | SR72 | SR76 | SR79 | SR82 | Trastuz Umab | HER2 Ab |
|---|---|---|---|---|---|---|---|
| U373 | 0.39 | 93.76 | 96.91 | 85.73 | 97.03 | 97.91 | 98.82 |
| U373 HER2 KO | 0.04 | 13.78 | 7.15 | 6.55 | 3.98 | 4.50 | 14.98 |

FIG. 52D

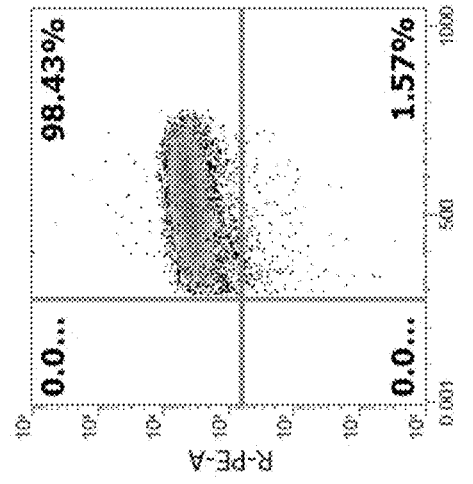
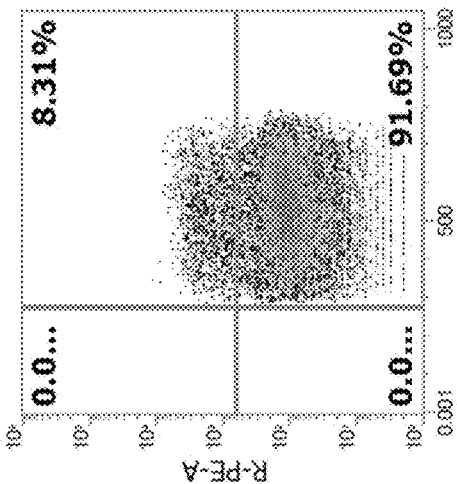
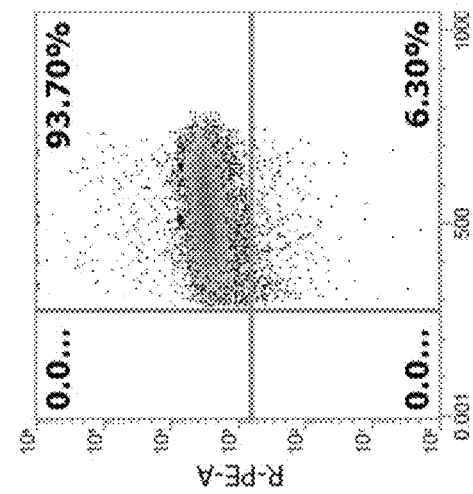
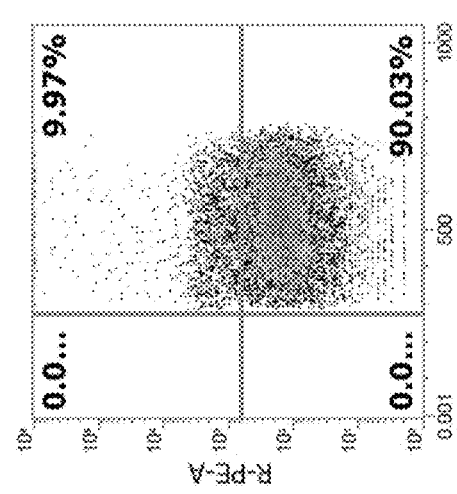
FIG. 53B

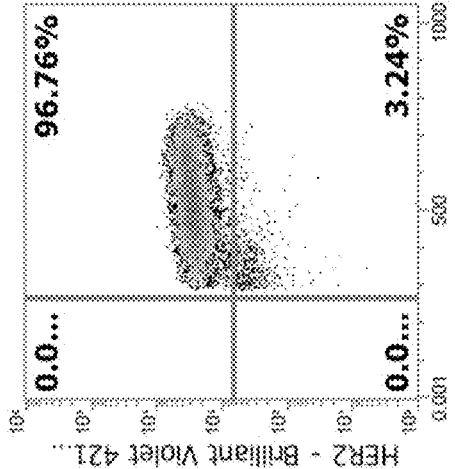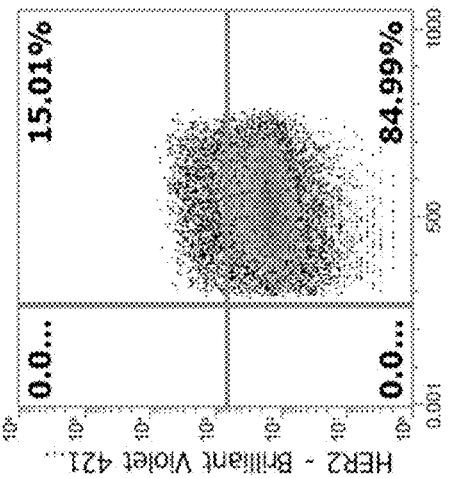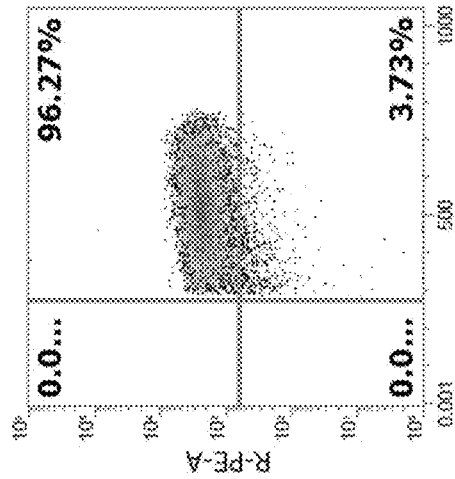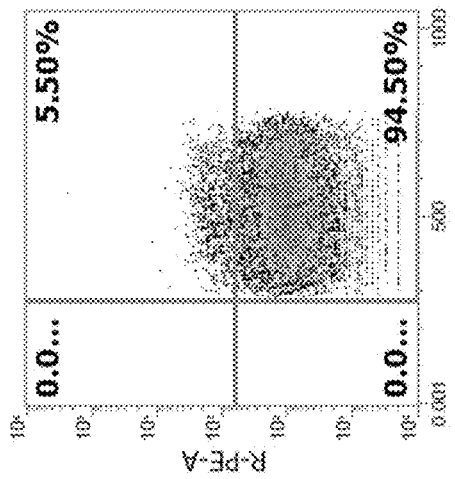
FIG. 53C

| (%) | 2nd Ab only | SR72 | SR76 | SR79 | SR82 | Trastuzumab | HER2 Ab |
|---|---|---|---|---|---|---|---|
| U373 | 0.51 | 97.60 | 98.65 | 93.70 | 98.43 | 96.27 | 96.76 |
| U373 HER2 KO | 0.30 | 7.91 | 10.56 | 9.97 | 8.31 | 5.50 | 15.01 |

FIG. 53D

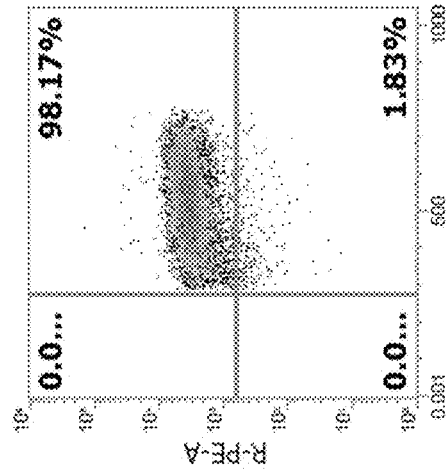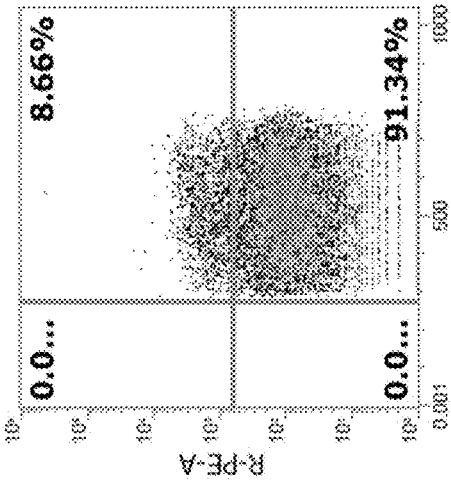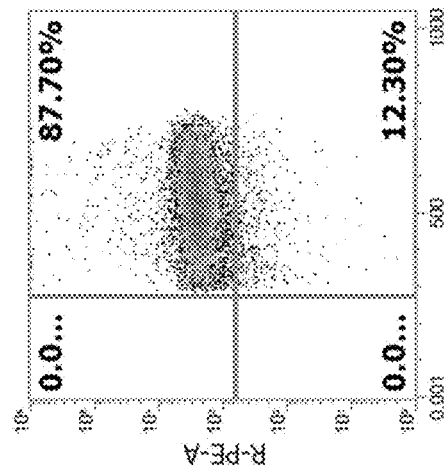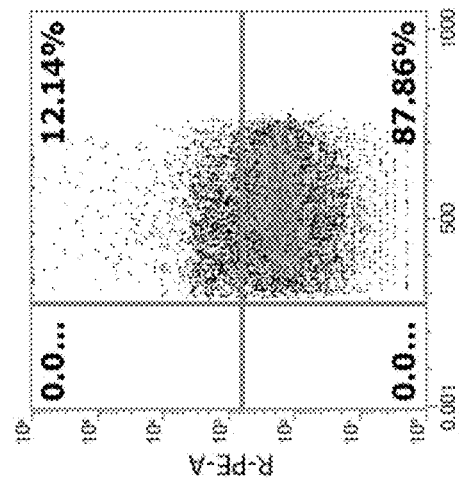
FIG. 54B

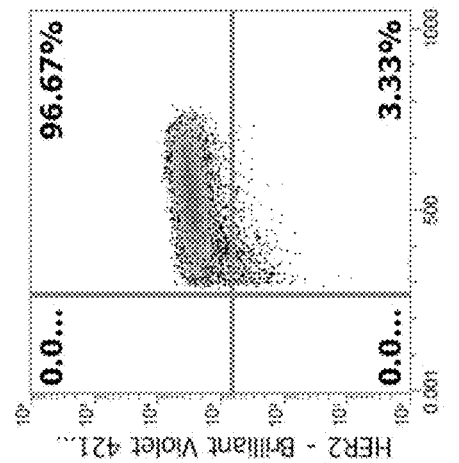
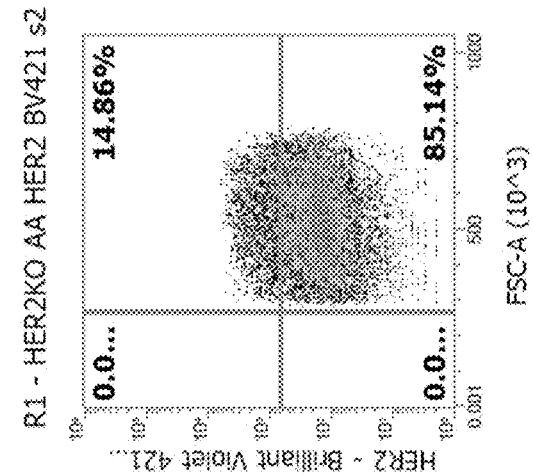
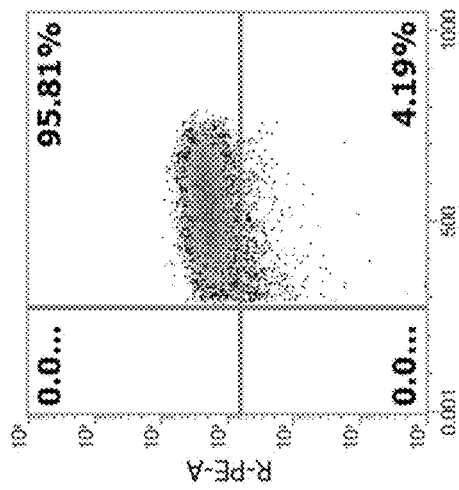
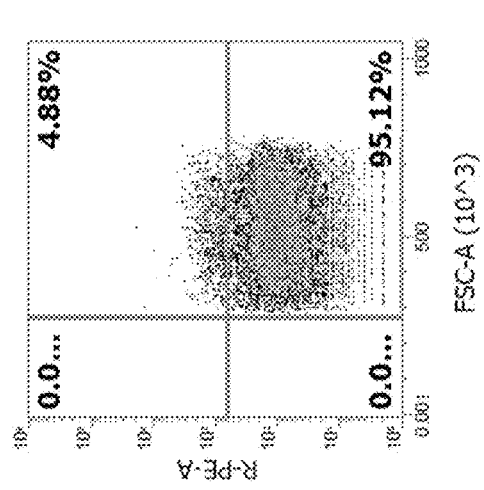
FIG. 54C

| (%) | 2nd Ab only | SR72 | SR76 | SR79 | SR82 | Trastuzumab | HER2 Ab |
|---|---|---|---|---|---|---|---|
| U373 | 0.45 | 97.37 | 98.48 | 87.70 | 98.17 | 95.81 | 96.67 |
| U373 HER2 KO | 0.26 | 7.58 | 10.84 | 12.14 | 8.66 | 4.88 | 14.86 |

FIG. 54D

| HER2 Nanobody | Kd (nM) |
|---|---|
| SR72 | 78.8 |
| SR78 | 47.9 |
| SR79 | 46.7 |
| SR82 | 60.4 |

FIG. 56

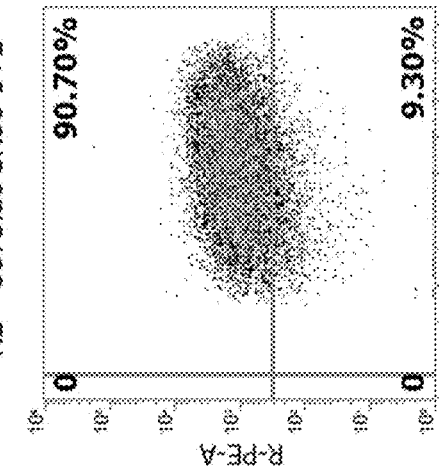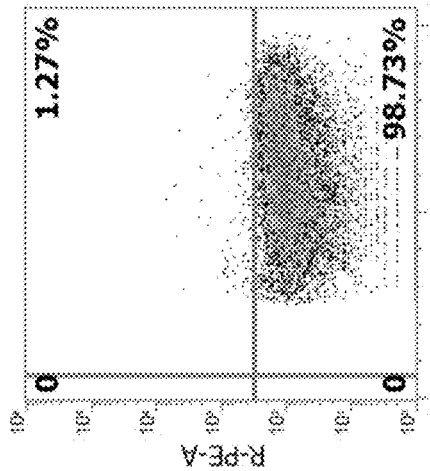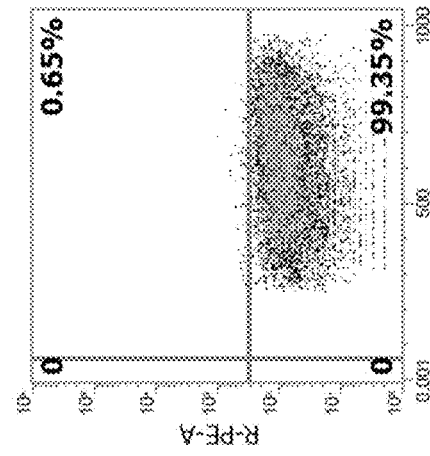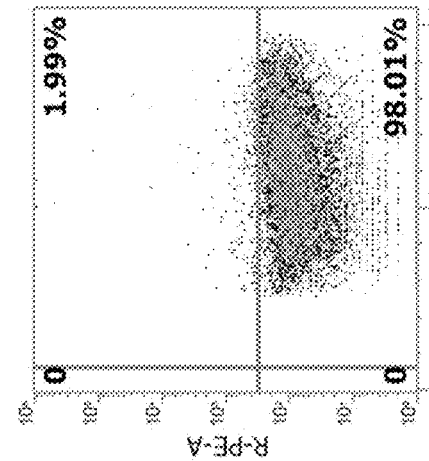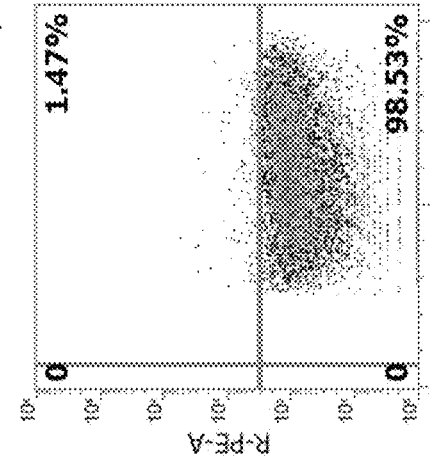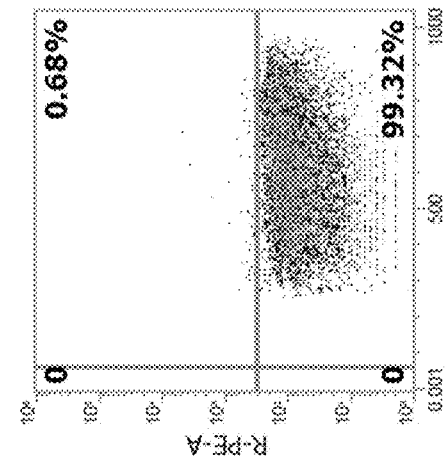
FIG. 66A

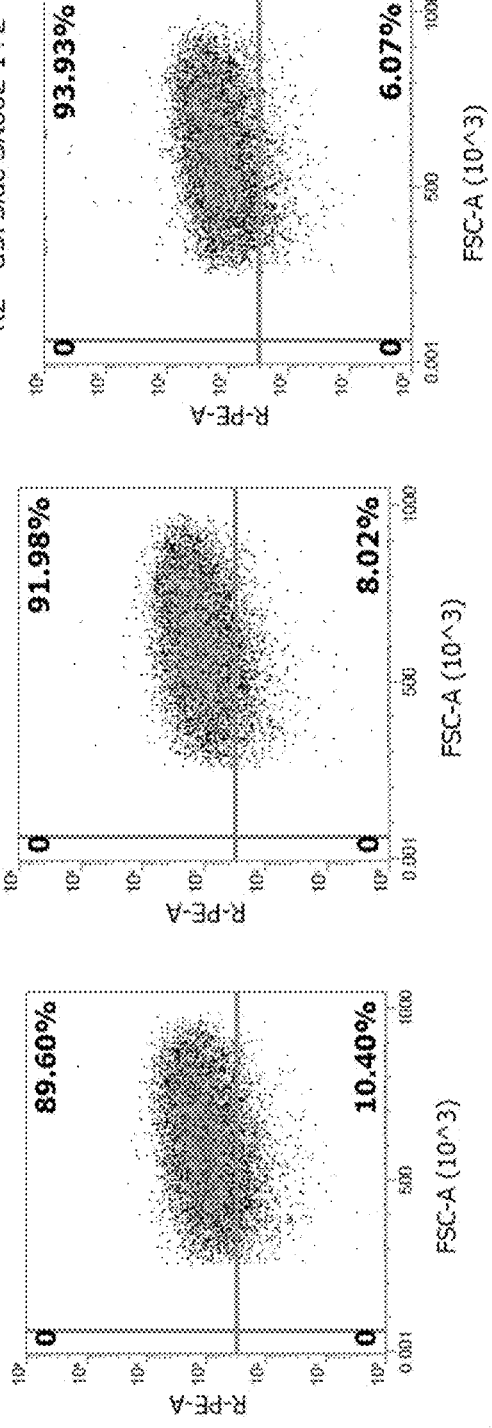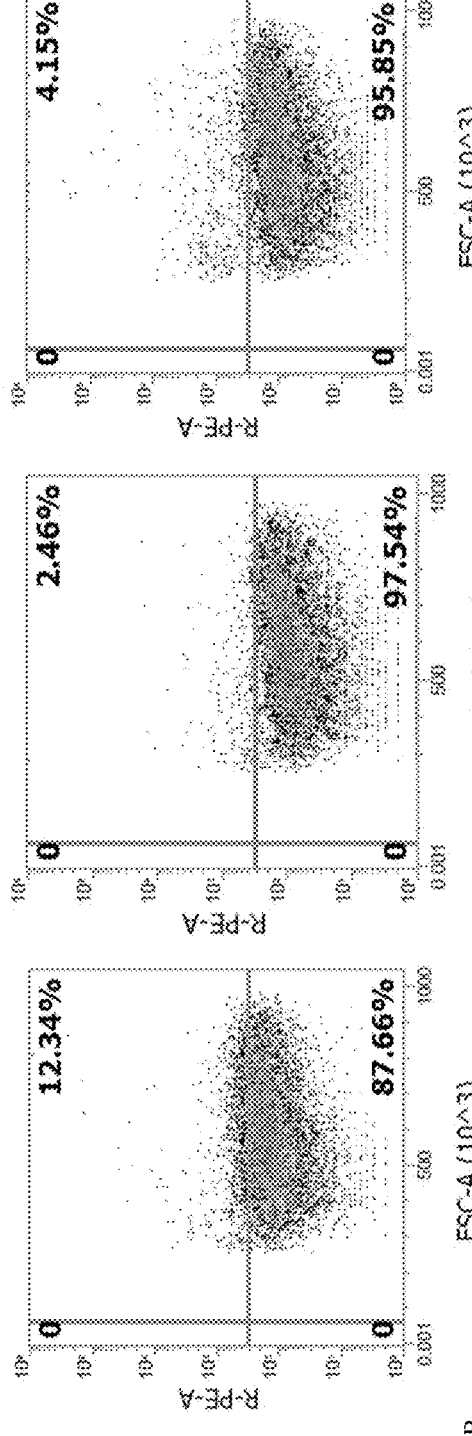
FIG. 66B

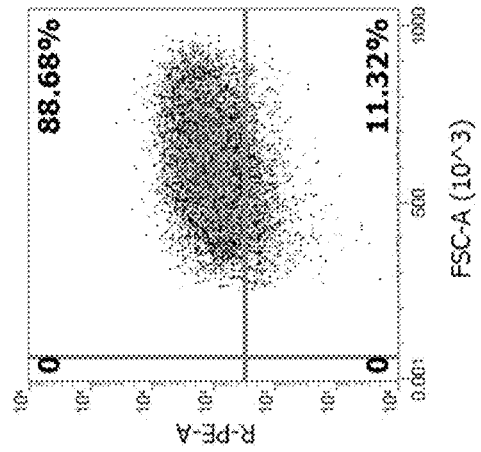
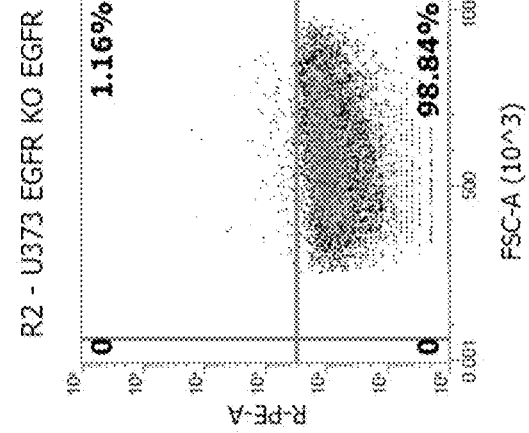
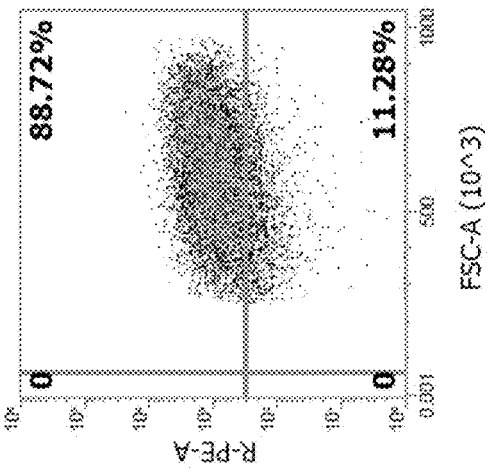
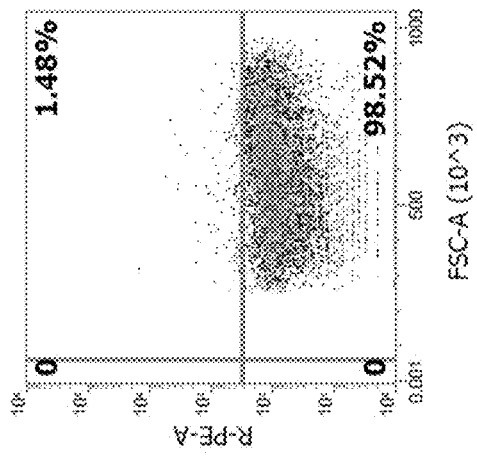
FIG. 66C

| (%) | unstained | 2nd Ab only | SR56 | SR59 | TD12 | 3DG7 | cetuxi-mab | EGFR 1st Ab Fitch |
|---|---|---|---|---|---|---|---|---|
| U373 | 0.65 | 1.27 | 90.70 | 89.60 | 91.93 | 93.93 | 88.72 | 88.68 |
| U373 EGFR KO | 0.68 | 1.47 | 1.99 | 12.34 | 4.15 | 4.15 | 1.48 | 1.16 |

FIG. 66D

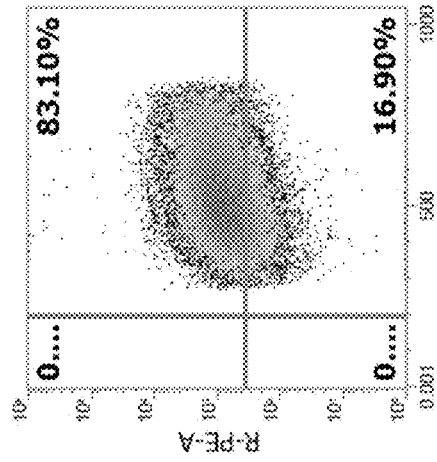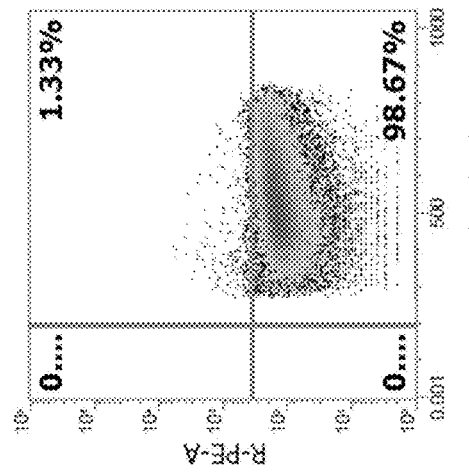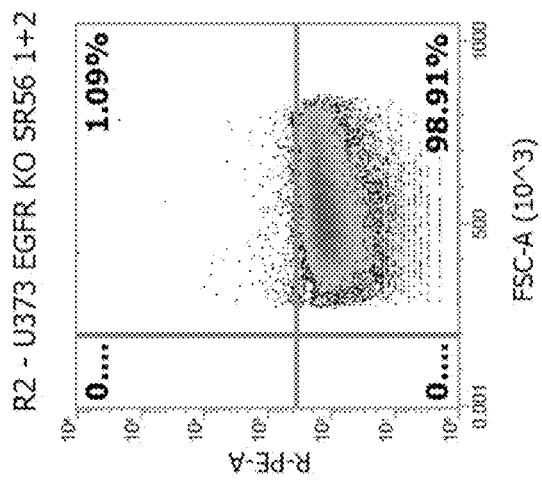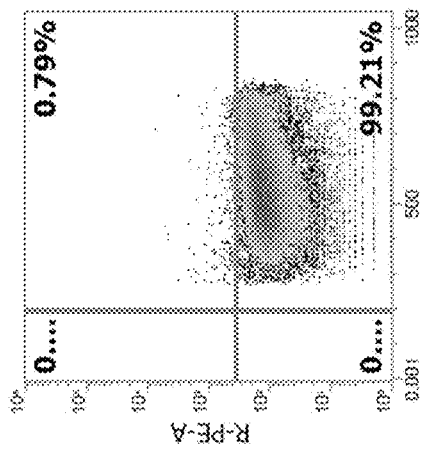
FIG. 67A

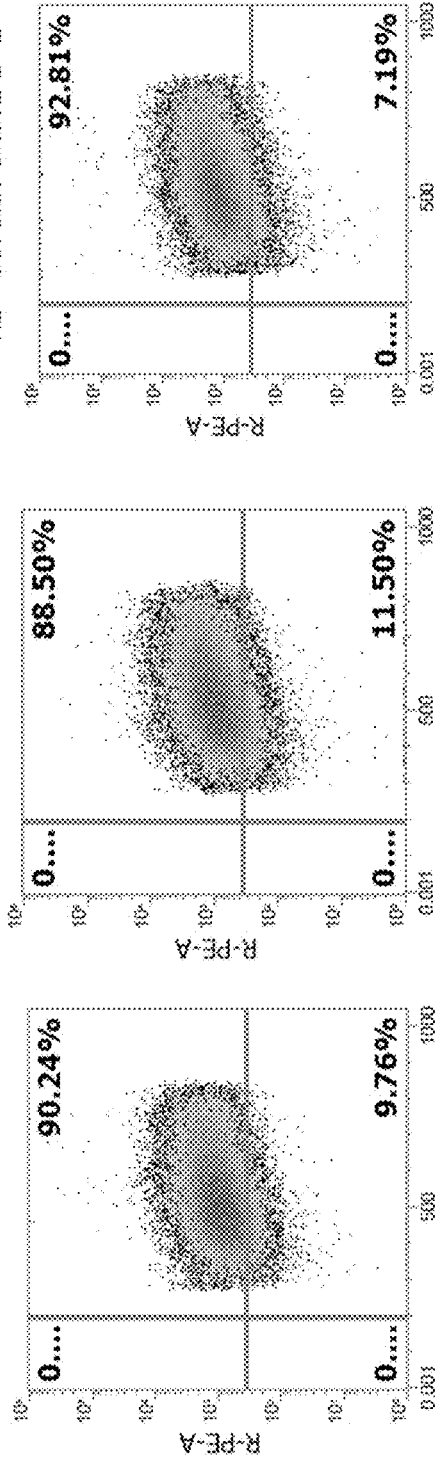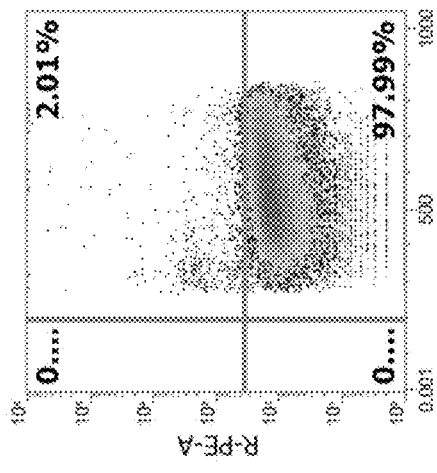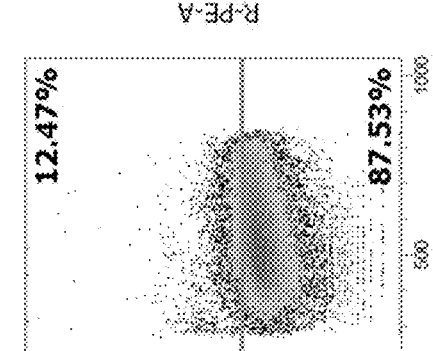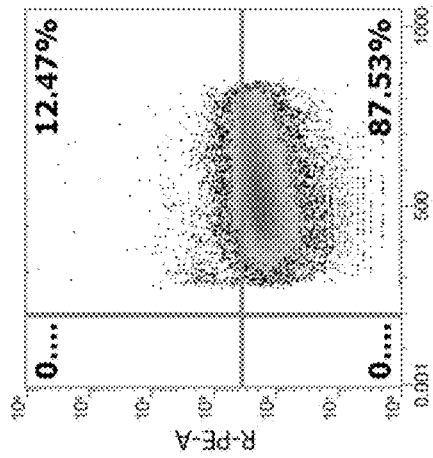
FIG. 67B

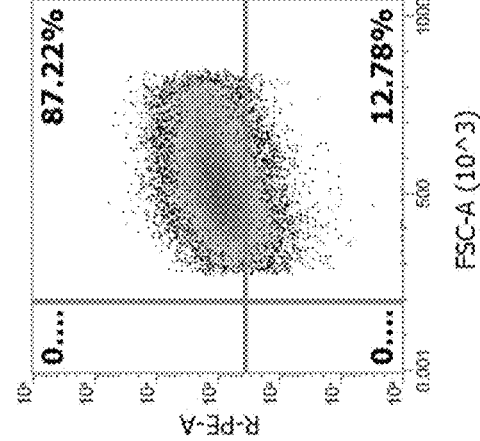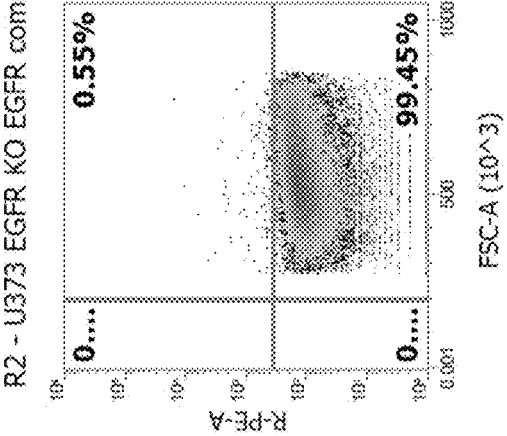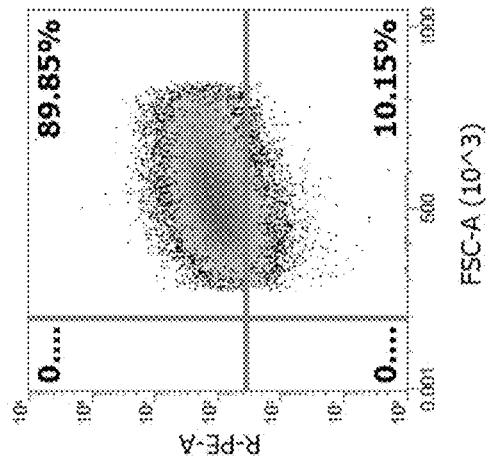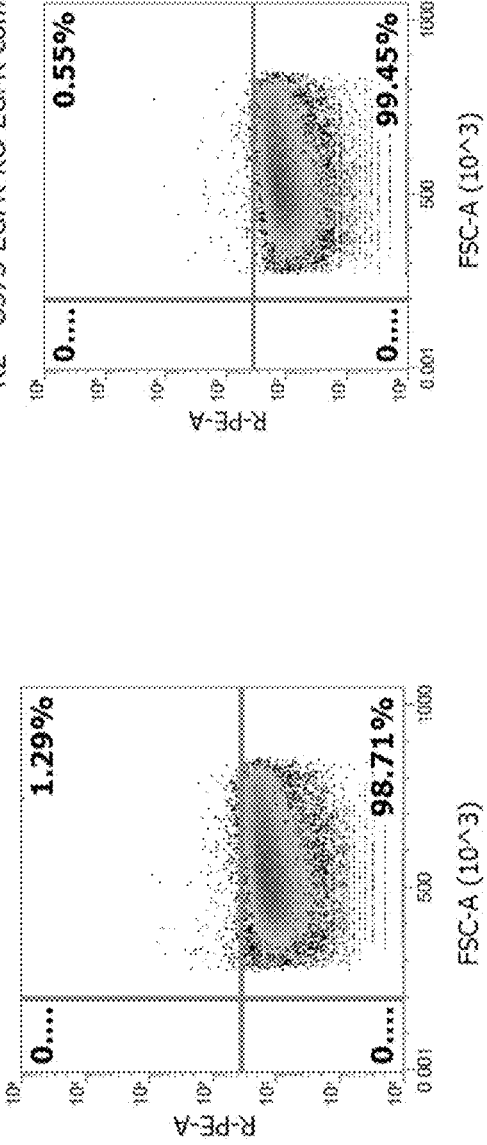
FIG. 67C

| (%) | 2nd Ab only | SR5G | SR5G | 7B12 | 38G7 | Cetuximab | EGFR 1st Ab Fitch |
|---|---|---|---|---|---|---|---|
| U373 | 1.33 | 83.10 | 90.24 | 88.50 | 92.81 | 89.85 | 87.22 |
| U373 EGFR KO | 0.79 | 1.09 | 12.47 | 1.63 | 2.01 | 1.29 | 0.55 |

FIG. 67D

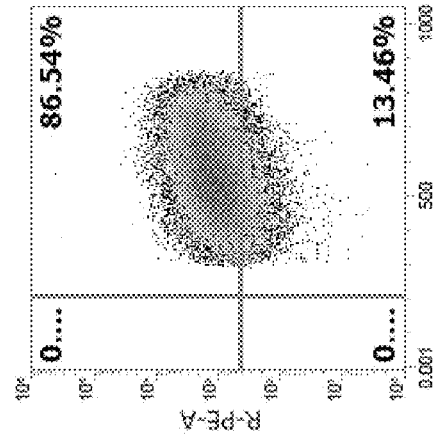
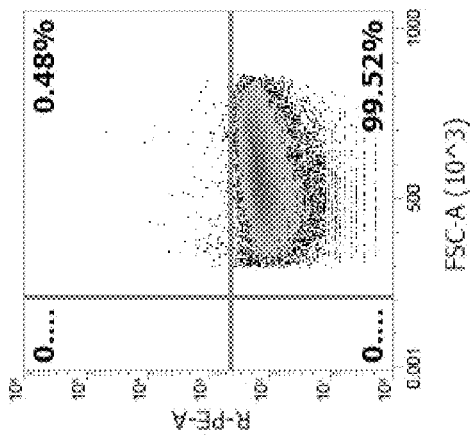
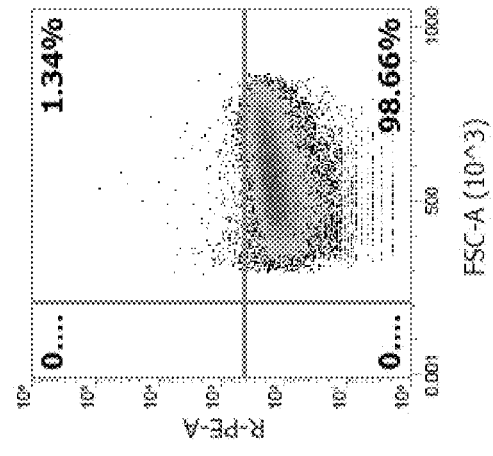
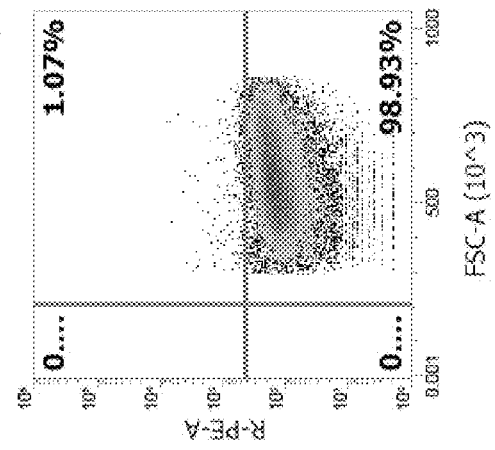
FIG. 68A

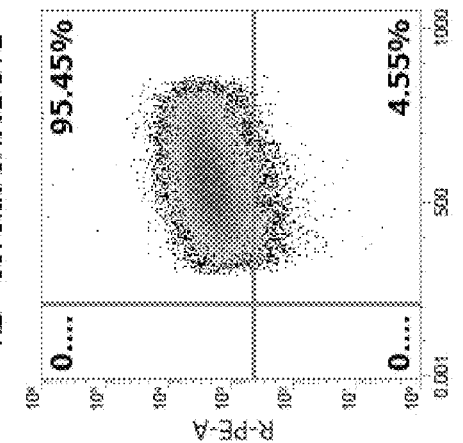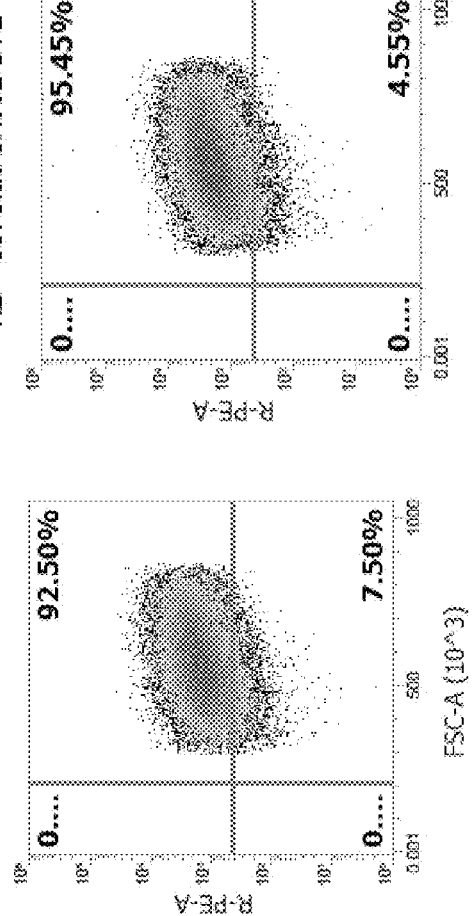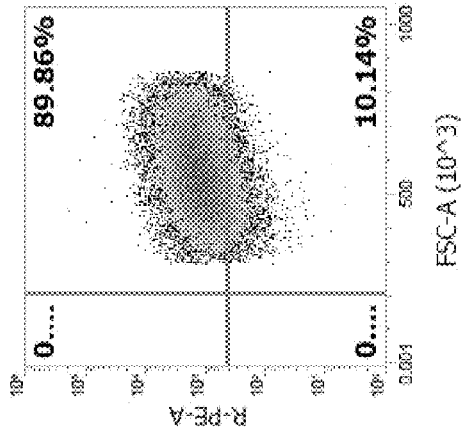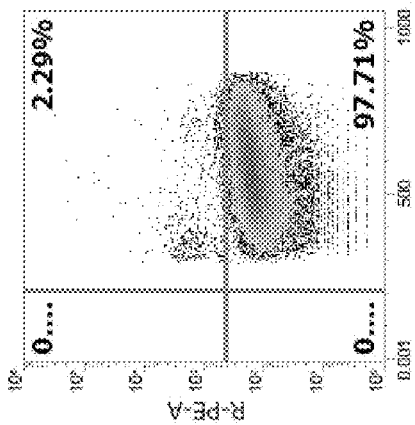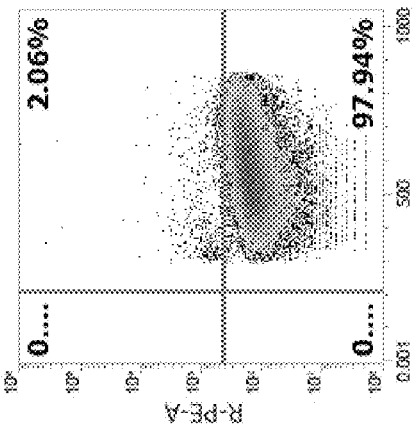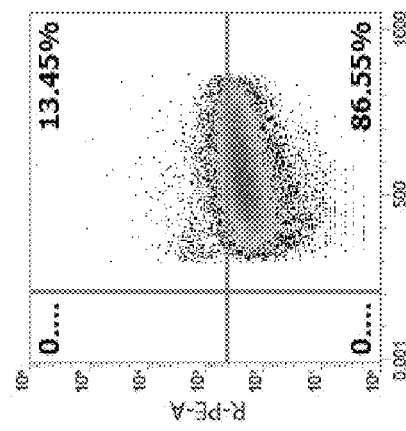
FIG. 68B

Cetuximab
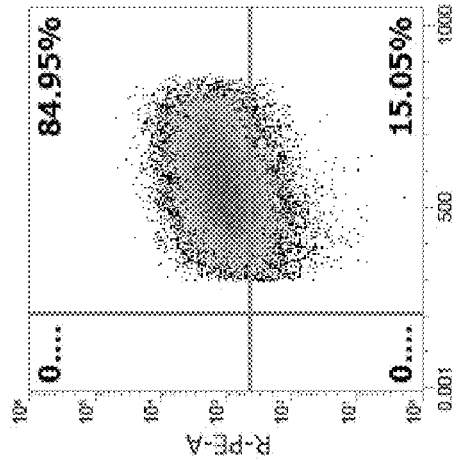
EGFR Ab
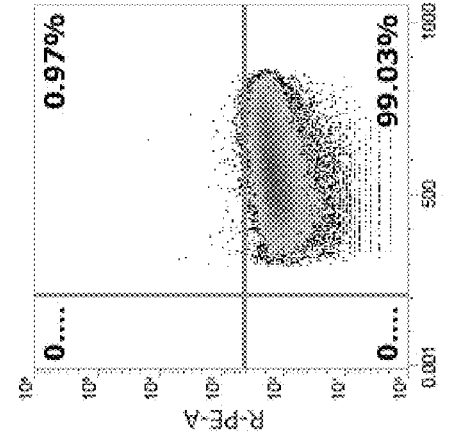
U373 WT
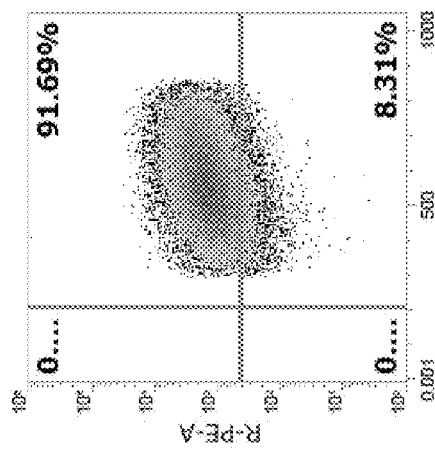
U373 EGFR KO
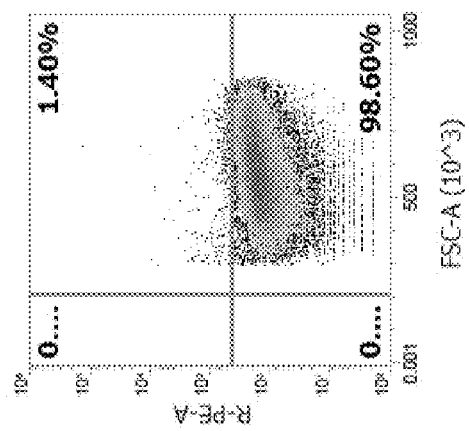
FIG. 68C

| (%) | 2nd Ab only | SR5G | SR59 | 7D12 | 38G7 | Cetuximab | EGFR 1st Ab Fitch |
|---|---|---|---|---|---|---|---|
| U373 | 0.48 | 86.54 | 89.85 | 92.50 | 95.45 | 91.69 | 84.95 |
| U373 EGFR KO | 1.07 | 1.34 | 13.45 | 2.06 | 2.29 | 1.40 | 0.97 |

FIG. 68D

| EGFR Nanobody | | KD (nM) |
|---|---|---|
| SR56 | EGFR-His | 5.99E-09 |
| | EGFR-vIII-His | 6.79E-08 |
| SR59 | EGFR-His | 4.93E-09 |
| | EGFR-vIII-His | 6.85E-08 |
| 7D12 | EGFR-His | 2.57E-09 |
| | EGFR-vIII-His | 5.98E-09 |
| 38G7 | EGFR-His | <1.0E-12 |
| | EGFR-vIII-His | 1.10E-09 |

FIG. 70

ARMED DUAL CAR-T COMPOSITIONS AND METHODS FOR CANCER IMMUNOTHERAPY

RELATED APPLICATION(S)

This application claims the benefit of and priority to U.S. Provisional Application No. 63/116,402, filed on Nov. 20, 2020, and U.S. Provisional Application No. 63/243,486, filed on Sep. 13, 2021. The entire teachings of the above applications are incorporated herein by reference.

INCORPORATION BY REFERENCE OF MATERIAL IN ASCII TEXT FILE

This application incorporates by reference the Sequence Listing contained in the following ASCII text file being submitted concurrently herewith:

File name: 58011000002SequenceListing.txt; created Nov. 19, 2021, 1,208,886 Bytes in size.

BACKGROUND

Therapies that attack tumors by engaging the immune system have been effective against a growing number of cancers. In some cancer types, particularly in solid tumors such as glioblastoma (GBM), however, antigen escape variants can lead to tumor recurrence after treatment with chimeric antigen receptor (CAR) T cells that are redirected to single tumor-associated antigens (TAAs). The limited spectrum of T cell specificity in the face of the heterogeneous and potentially dynamic antigen landscape remains a major challenge for CAR T cell therapy for solid tumors, including glioblastoma.

SUMMARY

There is a critical need to develop therapies for cancer that increase T cell functionality and reduce antigen escape.

The present disclosure is based, in part, on the discovery that T lymphocytes that have been engineered to express both a chimeric antigen receptor (CAR) (e.g., a bi-specific CAR that is capable of binding to HER2 and IL13Rα2) and a T-cell engager that is capable of binding to CD3 and a TAA (e.g., a tumor antigen, such as a glioblastoma tumor antigen) exhibit enhanced efficacy in treating certain types of cancers (e.g., tumors). Accordingly, the disclosure generally relates to polynucleotides comprising a sequence that encodes one or more CARs, one or more T-cell engagers, or a combination thereof, vectors (e.g., expression vectors), fusion proteins, host cells, T lymphocytes, compositions (e.g., pharmaceutical compositions) and kits comprising the polynucleotides; and methods of using said polynucleotides, vectors, fusion proteins, host cells, T lymphocytes, compositions and kits, for example, to treat a cancer in a subject.

In one aspect, the disclosure provides a polynucleotide, wherein the polynucleotide comprises a sequence encoding a chimeric antigen receptor (CAR) and a T-cell engager, wherein the CAR is capable of binding to one or more first tumor associated antigens (TAAs) and the T-cell engager is capable of binding to T-cell and a second TAA.

In another aspect, the disclosure provides a T-cell engager, wherein the T-cell engager is capable of binding to a T cell, a first TAA epitope, and a second TAA epitope. In some embodiments, the T-cell engager is produced in situ by a CAR T-cell through an interaction of a CAR and a first TAA.

In another aspect, the disclosure provides a polynucleotide comprising a sequence encoding a T-cell engager, wherein the T-cell engager is capable of binding to a T cell, a first TAA epitope, and a second TAA epitope.

In another aspect, the disclosure provides a polynucleotide, wherein the polynucleotide comprises a sequence encoding an amino acid sequence having at least 90% identical to at least one amino acid sequence independently selected from SEQ ID NOs: SEQ ID NOs: 2-4, SEQ ID NOs: 11-13 and 52, SEQ ID NOs: 15-17, SEQ ID NOs: 21-23 and 109-111, SEQ ID NOs: 49 and 50, SEQ ID NOs: 53-70, SEQ ID NOs: 72-82, SEQ ID NOs:83-104, SEQ ID NOs: 120-137, SEQ ID NOs: 139-149, SEQ ID NOs: 150-171, SEQ ID NOs: 188-191, SEQ ID NOs: 204 and 206-214, SEQ ID NOs: 215-221, or SEQ ID NOs: 242-291, or a combination thereof.

In a further aspect, the disclosure provides a vector, wherein the vector comprises one or more polynucleotides described herein.

In another aspect, the disclosure provides a fusion protein encoded by any one of the polynucleotide or vector described herein.

In an additional aspect, the disclosure provides a host cell, wherein the host cell comprises one or more polynucleotides, vectors, or fusion proteins described herein.

In another aspect, the disclosure provides a T lymphocyte comprising one or more polynucleotides, vectors, or fusion proteins described herein.

In a further aspect, the disclosure provides a composition, wherein the composition comprises one or more polynucleotides, vectors, fusion proteins, host cells, or T lymphocytes described herein.

In another aspect, the disclosure provides a pharmaceutical composition, wherein the pharmaceutical composition comprises one or more of the polynucleotides, vectors, fusion proteins, host cells, or T lymphocytes described herein, and a pharmaceutically acceptable carrier.

In an additional aspect, the disclosure provides a kit, wherein the kit comprises a container and, optionally, an instruction for use, wherein the container comprises one or more of the compositions (e.g., pharmaceutical compositions) described herein.

In another aspect, the disclosure provides a use of one or more polynucleotides, vectors, fusion proteins, host cells, T lymphocytes, compositions (e.g., pharmaceutical compositions), or kits described herein, for the preparation of a medicament for treating cancer in a subject in need thereof.

In another aspect, the disclosure provides one or more polynucleotides, vectors, fusion proteins, host cells, T lymphocytes, compositions (e.g., pharmaceutical compositions), or kits described herein, for use in treating cancer in a subject in need thereof. In certain embodiments, the disclosure provides one or more T lymphocytes, compositions, pharmaceutical compositions described herein, for use in treating cancer in a subject in need thereof. In particular embodiments, the disclosure provides one or more T lymphocytes described herein, for use in treating cancer in a subject in need thereof.

In another aspect, the disclosure provides a method of treating cancer in a subject in need thereof, comprising administering to the subject an effective dosage of one or more T lymphocytes, or compositions (e.g., pharmaceutical compositions), described herein.

In another aspect, the disclosure provides a T-cell engager (TE or BiTE) capable of binding to a T cell, a first TAA epitope, and a second TAA epitope, wherein the T-cell engager is produced in situ by a CAR T-cell (e.g., is released or secreted by a CAR T-cell) through an interaction of a CAR and a first TAA.

In another aspect, the disclosure provides a polypeptide comprising an amino acid sequence that is at least 90% identical to at least one amino acid sequence set forth in SEQ ID NOs: 2-4, 15-17 and 242-291.

In an additional aspect, the disclosure provides a polypeptide that specifically binds glypican-3 (GPC3), wherein the polypeptide comprises a heavy chain complementarity determining region 1 (HCDR1), a heavy chain complementarity determining region 2 (HCDR2) and a heavy chain complementarity determining region 3 (HCDR3), each comprising an amino acid sequence that is at least 90% identical to the amino acid sequence of a HCDR1, HCDR2 and HCDR3, respectively, of a heavy chain variable region ($V_H$) amino acid sequence set forth in SEQ ID NO: 284, SEQ ID NO: 286 or SEQ ID NO: 289.

Without being bound by any theory or hypothesis, one or more of the polynucleotides, vectors, fusion proteins, host cells, T lymphocytes, or compositions (e.g., pharmaceutical compositions) described in this disclosure provide superior (sometimes unexpected) results in killing or otherwise rendering cancer cells less effective when comparing to what other polynucleotides, vectors, fusion proteins, host cells, T lymphocytes, or compositions (e.g., pharmaceutical compositions) can. Again without being bound by any theory or hypothesis, one or more of the polynucleotides, vectors, fusion proteins, host cells, T lymphocytes, or compositions (e.g., pharmaceutical compositions) described in this disclosure can be used to effectively treat cancers, inter alia, with reduced side effects.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The foregoing will be apparent from the following more particular description of embodiments, as well as the accompanying drawings in which like reference characters refer to the same parts throughout the different views. The drawings are not necessarily to scale, emphasis instead being placed upon illustrating embodiments.

FIG. 2 shows average targeting percentages in GBM cancer cell lines. U87, U87 KO and U373 were engineered to express luciferase and eGFP. To generate knockout cell (U87 KO), IL13Rα2 was knocked out in U87 using CRISPR-cas9 gene editing. Three rounds of FACS assays were performed to determine the targets positive percentage of each cell line.

FIGS. 31A-B show FACS results characterizing TAA expression in the U251 GBM line expressing GFP and luciferase. EGFR, Her2 and IL13R2a were detected using anti-human EGFR, anti-Her2 and anti-IL13R2a antibody clones.

FIG. 40A shows the BLI results at critical time points. D_−1: One day prior to treatment; D_n: n days post treatment. Xenograft: 10,000 luciferase-labeled U87 cells were injected into right front brain. Treatment: one, 200,000 $CAR^+$ T cell injection 4 days post tumor xenograft. FIG. 40B shows BLI radiance results of individual mouse. FIG. 40C shows the survival rate.

FIG. 44A shows the BLI results at critical time points with the following abbreviations: D_−1: One day prior to treatment; D_n: n days post treatment. FIG. 44B shows the BLI radiance results of individual mouse (top panel) and average total radiance (bottom panel).

FIG. 45 summarizes results of toxicology studies. SR26 efficiently eradicates the GBM tumor, and no abnormal effects were observed in SR26-treated mice in acute (day 2) and chronic (day 14) studies.

FIGS. 52A-52D show the specificity of the anti-HER2 Vhh nanobody clones in the GBM cancer cell line U373. To further validate the specificity of the identified anti-HER2 Vhh nanobody lead clones (SR72, SR78-80, SR82 and SR87), the GBM cancer cell line U373, both WT & HER2 KO, were used for the side-by-side flow staining assay. The data each is the results of the first-round study. The Her2 antibody is the commercially available primary antibody labeled with PE and used as a control.

FIGS. 53A-53D show the specificity of the anti-HER2 Vhh nanobody clones in the GBM cancer cell line U373. To further validate the specificity of the identified anti-HER2 Vhh nanobody lead clones (SR72, SR78-80, SR82 and SR87), the GBM cancer cell line U373, both WT & HER2 KO, were used for the side-by-side flow staining assay. The data each is the results of the second-round study. The Her2 antibody is the commercially available primary antibody labeled with PE and used as a control.

FIGS. 54A-54D show the specificity of the anti-HER2 Vhh nanobody clones in the GBM cancer cell line U373. To further validate the specificity of the identified anti-HER2 Vhh nanobody lead clones (SR72, SR78-80, SR82 and SR87), the GBM cancer cell line U373, both WT & HER2 KO, were used for the side-by-side flow staining assay. The data each is the results of the third-round study. The Her2 antibody is the commercially available primary antibody labeled with PE and used as a control.

FIG. 56 summarizes the $K_D$ values of the anti-HER2 Vhh nanobody lead clones SR72, SR78-80, SR82 and SR87.

FIGS. 66A-66D show the specificity of the anti-EGFR Vhh nanobody clones in the GBM cancer cell line U373. To further validate the specificity of the identified anti-EGFR Vhh nanobody lead clones (SR56, SR59 7D12 and 38G7), the GBM cancer cell line U373, both WT & HER2 KO, were used for the side-by-side flow staining assay. The data each is the results of the first-round study. The EGFR Ab antibody is the commercially available primary antibody labeled with PE and used as a control.

FIGS. 67A-67D show the specificity of the anti-EGFR Vhh nanobody clones in the GBM cancer cell line U373. To further validate the specificity of the identified anti-EGFR Vhh nanobody lead clones (SR56, SR59 7D12 and 38G7), the GBM cancer cell line U373, both WT & HER2 KO, were used for the side-by-side flow staining assay. The data each is the results of the second-round study. The EGFR Ab antibody is the commercially available primary antibody labeled with PE and used as a control.

FIGS. 68A-68D show the specificity of the anti-EGFR Vhh nanobody clones in the GBM cancer cell line U373. To further validate the specificity of the identified anti-EGFR Vhh nanobody lead clones (SR56, SR59 7D12 and 38G7), the GBM cancer cell line U373, both WT & HER2 KO, were used for the side-by-side flow staining assay. The data each is the results of the third-round study. The EGFR Ab antibody is the commercially available primary antibody labeled with PE and used as a control.

FIG. 70 summarizes the $K_D$ values of the anti-EGFR Vhh nanobody lead clones SR56, SR59, 7D12 and 38G7.

DETAILED DESCRIPTION

Figure 1:
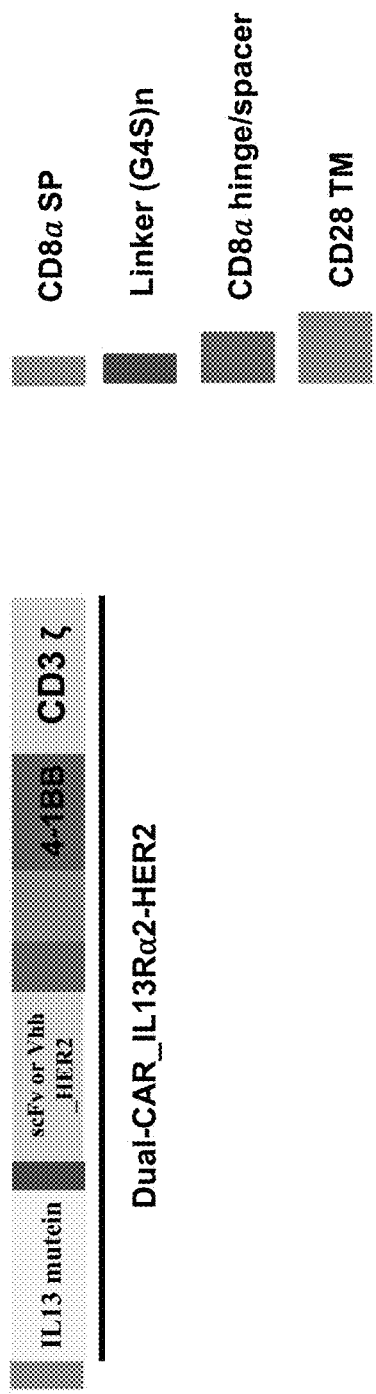
FIG. 1 is a graphic representation of a non-limiting example of Dual-CAR structures of the disclosure.

A description of embodiments follows.

Polynucleotides of the Disclosure

Polynucleotides Encoding CAR and T-Cell Engager (TE or BiTE)

In one aspect, the disclosure provides a polynucleotide, wherein the polynucleotide comprises a sequence encoding a chimeric antigen receptor (CAR) and a T-cell engager (TE or BiTE), wherein the CAR is capable of binding to one or more first TAAs, and wherein the T-cell engager (TE or BiTE) is capable of binding to T-cell and a second TAA. In some embodiments, the T-cell engager is capable of binding to CD2, CD3, VLA-1, CD8, CD4, CCR6, CXCR5, CD25, CD31, CD45RO, CD197, CD127, CD38, CD27, CD196, CD277, or CXCR3. In certain embodiments, the T-cell engager is capable of binding to CD2, CD3, CD31, or CD277. In particular embodiments, the T-cell engager is capable of binding to CD3.

In some embodiments, the polynucleotide comprises deoxyribonucleotides. In certain embodiments, the polynucleotide comprises ribonucleotides. Non-limiting examples of polynucleotides include single-, double- or multi-stranded DNA or RNA, DNA-RNA hybrids, or a polymer comprising purine and pyrimidine bases, or other natural, chemically or biochemically modified, non-natural, or derivatized nucleotide bases. The backbone of the polynucleotide can comprise sugars and phosphate groups, modified or substituted sugar or phosphate groups, a polymer of synthetic subunits such as phosphoramidates, or a combination thereof.

In some embodiments, the polynucleotide is isolated (e.g., produced synthetically or via molecular cloning). In some embodiments, the polynucleotide is integrated into the genomic DNA of a host cell (e.g., a T lymphocyte). In some embodiments, the polynucleotide is extrachromosomal (e.g., on a plasmid, on a viral vector) within a host cell. In some embodiments, the polynucleotide is a DNA. In some embodiments, the polynucleotide is a RNA. The polynucleotide can be inserted into a plasmid or vector, such as a viral vector (e.g., a lentiviral vector). In addition, the polynucleotide can include one or more modified nucleotides (e.g., one or more chemically modified nucleotides).

In some embodiments, the CAR is monospecific. In other embodiments, the CAR is bispecific. In certain embodiments, the CAR is capable of binding two epitopes of a first TAA. In particular embodiments, the CAR is capable of binding two first TAAs.

In some embodiments, the one or more first TAAs and the second TAA each independently is expressed on a hematologic cancer (e.g., leukemia, lymphoma, myeloma) cell. Hematologic cancers that can be treated according to the methods described herein include leukemias (e.g., acute leukemias, chronic leukemias), lymphomas (e.g., B-cell lymphoma, T-cell lymphoma) and multiple myeloma.

Accordingly, in some embodiments, the one or more first TAAs, the second TAA, or both are expressed on a hematologic cancer cell selected from leukemia (e.g., acute leukemias, chronic leukemias), lymphoma (e.g., B-cell lymphoma, T-cell lymphoma) and multiple myeloma cells.

In some embodiments, the one or more first TAAs and the second TAA each independently is expressed on a solid tumor cell (e.g., a tumor of the breast, lung, prostate, colon, bladder, ovary, kidney, stomach, colon, rectum, testes, head and/or neck, pancreas, brain, skin). Accordingly, in some embodiments, the one or more first TAAs and the second TAA each independently is expressed on a solid tumor cell selected from breast, lung, prostate, colon, bladder, ovarian, renal, gastric, rectal, colorectal, testicular, head and neck, pancreatic, brain and skin cancer cells.

In certain embodiments, the solid tumor is a brain tumor, breast cancer, lung cancer or liver cancer. In some embodiments, the brain tumor is glioblastoma (GBM). In certain embodiments, the GBM is primary glioblastoma multiforme. In particular embodiments, the GBM is recurrent glioblastoma multiforme. In some embodiments, the brain tumor is a brain metastatic tumor. In certain embodiments, the brain metastatic tumor is non-small cell lung cancer brain metastases (NSCLCBM), small cell lung cancer brain metastases (SCLCBM), HER2-positive metastatic breast cancer or triple-negative breast cancer brain metastases (TNBCBM). In some embodiments, the liver cancer is hepatocellular carcinoma (HCC).

In some embodiments, the one or more first TAAs are each independently selected from colon cancer antigen 19.9; a gastric cancer mucin; antigen 4.2; glycoprotein A33 (gpA33); ADAM-9; gastric cancer antigen AH6; ALCAM; malignant human lymphocyte antigen APO-1; cancer antigen B1; B7 H3; beta-catenin; blood group ALeb/Ley; Burkitt's lymphoma antigen-38.13, colonic adenocarcinoma antigen C14; ovarian carcinoma antigen CA125; Carboxypeptidase M; CD5; CD19; CD20; CD22; CD23; CD25; CD27; CD30; CD33; CD36; CD45; CD46; CD52; CD79a/CD79b; CD103; CD317; CDK4; carcinoembryonic antigen (CEA); CEACAM5; CEACAM6; C017-iA; CO-43 (blood group Leb); CO-514 (blood group Lea); CTA-1; CTLA4; Cytokeratin 8; antigen D1.1; antigen D 156-22; DR5; Ei series (blood group B); EGFR (Epidermal Growth Factor Receptor); Ephrin receptor A2 (EphA2); ErbB1; ErbB3; ErbB4; GAGE-1; GAGE-2; GD2/GD3/GM2; lung adenocarcinoma antigen F3; antigen FC10.2; G49, ganglioside GD2; ganglioside GD3; ganglioside GM2; ganglioside GM3; GD2; GD3; GICA 19-9; GM2; gpOO; glypican-3 (GPC3); human leukemia T cell antigen Gp37; melanoma antigen gp75; gpA33; HER2 antigen (e.g., pi85 HER2); human milk fat globule antigen (HMFG); human papillomavirus E6/human papillomavirus-E7; high molecular weight melanoma antigen (IMW MAA); I antigen (differentiation antigen) I(Ma); Integrin Alpha-V-Beta-6 IntegrinP6 (ITGB6); Interleukin-13; Receptor a2 (IL13Rα2); JAM-3; KID3; KID31; KS 1/4 pan carcinoma antigen; human lung carcinoma antigens L6 and L20; LEA; LUCA-2; Mi:22:25:8; M18; M39; MAGE-1; MAGE-3; MART; MUC-1; MUM-1; Myl; N acetylglucosaminyltransferase; neoglycoprotein; NS-10; OFA-1; OFA-2; Oncostatin M; p15; melanoma-associated antigen p97; polymorphic epithelial mucin (PEM); polymorphic epithelial mucin antigen (PEMA); PIPA; prostate-specific antigen (PSA); prostate-specific membrane antigen (PSMA); prostatic acid phosphate; R2 4; RORi; sphingolipids; SSEA-1; SSEA-3; SSEA-4; sTn; T cell receptor derived peptide; T 5A7; TAG-72; TL5 (blood group A); TNF-α receptor; TNF-β receptor; TNF-γ receptor; TRA-1-85 (blood group H); Transferrin Receptor; tumor-specific transplantation antigen (TSTA), oncofetal antigen-alpha-fetoprotein (AFP); VEGF; VEGFR, VEP8; VEP9; VIMN-D5; and Y hapten, Ley.

In some embodiments, the one or more first TAAs are each independently selected from interleukin-13 receptor subunit alpha-2 (IL13Rα2), human epidermal growth factor receptor 2 (HER2), epidermal growth factor receptor (EGFR), EGFR variant III (EGFRvIII), glypican-3 (GPC3) and combinations thereof.

In some embodiments, the CAR comprises a mutein, a single-chain variable fragment (scFv), a nanobody, or a combination thereof. In certain embodiments, the CAR comprises a mutein and a scFv, two nanobodies, a mutein and two nanobodies, or a scFv and a nanobody.

In some embodiments, the CAR comprises:
an IL13 mutein;
an HER2-binding scFv;
an IL13 mutein and a HER2-binding scFv;
a HER2-binding nanobody;
two HER2-binding nanobodies;
an IL13 mutein and two HER2-binding nanobodies;
an EGFR-binding scFv;
an EGFRvIII-binding scFv;
an EGFR-binding nanobody;
an EGFRvIII-binding nanobody;
two EGFR or EGFRvIII-binding nanobodies;
a GPC3-binding nanobody; or
a GPC3-binding nanobody and a GPC3-binding scFv.
In certain embodiments:
the IL13 mutein comprises an amino acid sequence that is at least 60% identical to the amino acid sequence of SEQ ID NO: 1;
the HER2-binding scFv comprises an amino acid sequence that is at least 60% identical to at least one amino acid sequence set forth in SEQ ID NOs: 2-4;
the HER2-binding nanobody comprises an amino acid sequence that is at least 60% identical to at least one amino acid sequence set forth in SEQ ID NOs: 242-259;
the EGFR-binding nanobody comprises an amino acid sequence that is at least 60% identical to at least one amino acid sequence set forth in SEQ ID NOs: 15-17 and 260-281;
the EGFRvIII-binding nanobody comprises an amino acid sequence that is at least 60% identical to at least one amino acid sequence set forth in SEQ ID NOs: 15-17 and 260-281; or
the GPC3-binding nanobody comprises an amino acid sequence that is at least 60% identical to at least one amino acid sequence set forth in any one of SEQ ID NOs: 282-291,
or a combination thereof.

For example, the sequence identity can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%.

In particular embodiments:
the IL13 mutein comprises an amino acid sequence that is at least 90% identical to the amino acid sequence of SEQ ID NO: 1;

the HER2-binding scFv comprises an amino acid sequence that is at least 90% identical to at least one amino acid sequence set forth in SEQ ID NOs: 2-4;

the HER2-binding nanobody comprises an amino acid sequence that is at least 90% identical to at least one amino acid sequence set forth in SEQ ID NOs: 242-259;

the EGFR-binding nanobody comprises an amino acid sequence that is at least 90% identical to at least one amino acid sequence set forth in SEQ ID NOs: 15-17 and 260-281;

the EGFRvIII-binding nanobody comprises an amino acid sequence that is at least 90% identical to at least one amino acid sequence set forth in SEQ ID NOs: 15-17 and 260-281; or the GPC3-binding nanobody comprises an amino acid sequence that is at least 90% identical to at least one amino acid sequence set forth in any one of SEQ ID NOs: 282-291, or a combination thereof.

In some embodiments:

the IL13 mutein comprises at least one amino acid substitution, relative to the amino acid sequence of SEQ ID NO: 1;

the HER2-binding scFv comprises at least one amino acid substitution, relative to at least one amino acid sequence set forth in SEQ ID NOs: 2-4;

the HER2-binding nanobody comprises at least one amino acid substitution, relative to at least one amino acid sequence set forth in SEQ ID NOs: 242-259;

the EGFR-binding nanobody comprises at least one amino acid substitution, relative to at least one amino acid sequence set forth in SEQ ID NOs: 15-17 and 260-281;

the EGFRvIII-binding nanobody comprises at least one amino acid substitution, relative to at least one amino acid sequence set forth in SEQ ID NOs: 15-17 and 260-281; or the GPC3-binding nanobody comprises at least one amino acid substitution, relative to at least one amino acid sequence set forth in SEQ ID NOs: 282-291, or a combination thereof.

The amino acid substitution(s) in a CAR or T-cell engager (TE or BiTE) of the disclosure can be substitutions with a canonical amino acid or a non-canonical amino acid. Non-canonical amino acids include, but are not limited to D-amino acids, such as D versions of the canonical L-amino acids.

In some embodiments, the amino acid substitutions include at least one conservative substitution.

In some embodiments, the amino acid substitutions include at least one highly conservative substitution.

In some embodiments, the at least one amino acid substitution is at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions. In some embodiments, the at least one amino acid substitution is about 1-45 amino acid substitutions, for example, about: 1-40, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions. In certain embodiments, the at least one amino acid substitution is about 1-25 amino acid substitutions, for example, about: 1-22, 2-22, 2-20, 3-20, 3-18, 4-18, 4-16, 5-16, 5-14, 6-14, 6-12, 7-12, 7-10 or 8-10 amino acid substitutions. In particular embodiments, the at least one amino acid substitution is about 1-12 amino acid substitutions, for example, about: 1-11, 2-11, 2-10, 3-10, 3-9, 4-9, 4-8, 5-8, 5-7 or 6-7 amino acid substitutions.

In certain embodiments:

the IL13 mutein comprises about 1-12 amino acid substitutions, relative to the amino acid sequence of SEQ ID NO: 1;

the HER2-binding scFv comprises about 1-25 amino acid substitutions, relative to at least one amino acid sequence set forth in SEQ ID NOs: 2-4;

the HER2-binding nanobody comprises about 1-12 amino acid substitutions, relative to at least one amino acid sequence set forth in SEQ ID NOs: 242-259;

the EGFR-binding nanobody comprises about 1-12 amino acid substitutions, relative to at least one amino acid sequence set forth in SEQ ID NOs: 15-17 and 260-281;

the EGFRvIII-binding nanobody comprises about 1-12 amino acid substitutions, relative to at least one amino acid sequence set forth in SEQ ID NOs: 15-17 and 260-281; or the GPC3-binding nanobody comprises about 1-12 amino acid substitutions, relative to at least one amino acid sequence set forth in SEQ ID NOs: 282-291, or a combination thereof.

In particular embodiments:

the IL13 mutein comprises the amino acid sequence of SEQ ID NO: 1;

the HER2-binding scFv comprises the amino acid sequence of any one of SEQ ID NOs: 2-4;

the HER2-binding nanobody comprises the amino acid sequence of any one of SEQ ID NOs: 242-259;

the EGFR-binding nanobody comprises the amino acid sequence of any one of SEQ ID NOs: 15-17 and 260-281;

the EGFRvIII-binding nanobody comprises the amino acid sequence of any one of SEQ ID NOs: 15-17 and 260-281; or the GPC3-binding nanobody comprises the amino acid sequence of any one of SEQ ID NOs: 282-291, or a combination thereof.

In some embodiments, the CAR (e.g., bi-specific CAR) further comprises a linker, a CD8a signal peptide, a CD8a hinge, a CD28 transmembrane domain, a 4-1BB costimulatory domain or a CD3ζ signaling domain, or a combination thereof. In some embodiments, the bi-specific CAR further comprises a CD8a signal peptide, a CD8a hinge, a CD28 transmembrane domain, a 4-1BB costimulatory domain and a CD3ζ signaling domain.

In some embodiments, the linker comprises an amino acid sequence that is at least 90% (e.g., 91%, 92%, 93%, 94%, 95%, 96%, 97%, 98% or 99%) identical to the amino acid sequence of SEQ ID NO: 5. In some embodiments, the CD8a signal peptide comprises an amino acid sequence that is at least 90% (e.g., 91%, 92%, 93%, 94%, 95%, 96%, 97%, 98% or 99%) identical to the amino acid sequence of SEQ ID NO: 6. In some embodiments, the CD8a hinge comprises an amino acid sequence that is at least 90% (e.g., 91%, 92%, 93%, 94%, 95%, 96%, 97%, 98% or 99%) identical to the amino acid sequence of SEQ ID NO: 7. In some embodiments, the CD28 transmembrane domain comprises an amino acid sequence that is at least 90% (e.g., 91%, 92%, 93%, 94%, 95%, 96%, 97%, 98% or 99%) identical to the amino acid sequence of SEQ ID NO: 8. In some embodiments, the 4-1BB costimulatory domain comprises an amino acid sequence that is at least 90% (e.g., 91%, 92%, 93%, 94%, 95%, 96%, 97%, 98% or 99%) identical to the amino acid sequence of SEQ ID NO: 9. In some embodiments, the CD3ζ signaling domain comprises an amino acid sequence that is at least 90% (e.g., 91%, 92%, 93%, 94%, 95%, 96%, 97%, 98% or 99%) identical to the amino acid sequence of SEQ ID NO: 10.

In certain embodiments, the linker comprises 1 or 2 amino acid substitutions, relative to the amino acid sequence of SEQ ID NO: 5. In some embodiments, the CD8a signal peptide comprises 1 or 2 amino acid substitutions, relative to the amino acid sequence of SEQ ID NO: 6. In some embodiments, the CD8a hinge comprises about 1-5 amino acid substitutions, relative to the amino acid sequence of SEQ ID NO: 7. In some embodiments, the CD28 transmembrane domain comprises about 1-3 amino acid substitutions, relative to the amino acid sequence of SEQ ID NO: 8. In some embodiments, the 4-1BB costimulatory domain comprises about 1-5 amino acid substitutions, relative to the amino acid sequence of SEQ ID NO: 9. In some embodiments, the CD3ζ signaling domain comprises about 1-12 amino acid substitutions, relative to the amino acid sequence of SEQ ID NO: 10.

In particular embodiments, the linker comprises the amino acid sequence of SEQ ID NO: 5. In some embodiments, the CD8a signal peptide comprises the amino acid sequence of SEQ ID NO: 6. In some embodiments, the CD8a hinge comprises the amino acid sequence of SEQ ID NO: 7. In some embodiments, the CD28 transmembrane domain comprises the amino acid sequence of SEQ ID NO: 8. In some embodiments, the 4-1BB costimulatory domain comprises the amino acid sequence of SEQ ID NO: 9. In some embodiments, the CD3ζ signaling domain comprises the amino acid sequence of SEQ ID NO: 10.

In some embodiments, the second TAA is IL13Rα2, HER2, EGFR, EGFRvIII, or GPC3.

In certain embodiments, the T-cell engager (TE or BiTE) comprises a scFv, a nanobody, or a combination thereof.

In particular embodiments, the T-cell engager (TE or BiTE) comprises an CD3-binding scFv. In particular embodiments, the T-cell engager (TE or BiTE) comprises an epidermal growth factor receptor (EGFR)-binding scFv. In particular embodiments, the T-cell engager (TE or BiTE) comprises an EGFR-binding nanobody. In particular embodiments, the T-cell engager (TE or BiTE) comprises two EGFR-binding nanobodies. In particular embodiments, the T-cell engager (TE or BiTE) comprises two glypican-3 (GPC3)-binding nanobodies.

In some embodiments, the EGFR or EGFRvIII-binding nanobody comprises an amino acid sequence that is at least 60% identical to at least one amino acid sequence set forth in SEQ ID NOs: 15-17 and 260-281. In some embodiments, the GPC3-binding nanobody comprises an amino acid sequence that is at least 60% identical to at least one amino acid sequence set forth in SEQ ID NOs: 282-291.

For example, the sequence identity can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%.

In particular embodiments, the EGFR or EGFRvIII-binding nanobody comprises an amino acid sequence that is at least 90% (e.g., 91%, 92%, 93%, 94%, 95%, 96%, 97%, 98% or 99%) identical to at least one amino acid sequence set forth in SEQ ID NOs: 15-17 and 260-281. In some embodiments, the GPC3-binding nanobody comprises an amino acid sequence that is at least 90% (e.g., 91%, 92%, 93%, 94%, 95%, 96%, 97%, 98% or 99%) identical to at least one amino acid sequence set forth in SEQ ID NOs: 282-291.

In some embodiments, the EGFR-binding nanobody comprises at least one amino acid substitution, relative to at least one amino acid sequence set forth in SEQ ID NOs: 15-17 and 260-281. In some embodiments, the EGFRvIII-binding nanobody comprises at least one amino acid substitution, relative to at least one amino acid sequence set forth in SEQ ID NOs: 15-17 and 260-281. In some embodiments, the GPC3-binding nanobody comprises at least one amino acid substitution, relative to at least one amino acid sequence set forth in SEQ ID NOs: 282-291.

In some embodiments, the at least one amino acid substitution is at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions. In some embodiments, the at least one amino acid substitution is about 1-45 amino acid substitutions, for example, about: 1-40, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions. In certain embodiments, the at least one amino acid substitution is about 1-25 amino acid substitutions, for example, about: 1-22, 2-22, 2-20, 3-20, 3-18, 4-18, 4-16, 5-16, 5-14, 6-14, 6-12, 7-12, 7-10 or 8-10 amino acid substitutions. In particular embodiments, the at least one amino acid substitution is about 1-12 amino acid substitutions, for example, about: 1-11, 2-11, 2-10, 3-10, 3-9, 4-9, 4-8, 5-8, 5-7 or 6-7 amino acid substitutions.

In certain embodiments, the EGFR-binding nanobody comprises about 1-12 amino acid substitutions, relative to at least one amino acid sequence set forth in SEQ ID NOs: 15-17 and 260-281. In certain embodiments, the EGFRvIII-binding nanobody comprises about 1-12 amino acid substitutions, relative to at least one amino acid sequence set forth in SEQ ID NOs: 15-17 and 260-281. In certain embodiments, the GPC3-binding nanobody comprises about 1-12 amino acid substitutions, relative to at least one amino acid sequence set forth in SEQ ID NOs: 282-291.

In particular embodiments, the EGFR or EGFRvIII-binding nanobody comprises the amino acid sequence set forth in any one of SEQ ID NOs: 15-17 and 260-281. In particular embodiments, the GPC3-binding nanobody comprises the amino acid sequence set forth in any one of SEQ ID NOs: 282-291.

In some embodiments, the T-cell engager (TE or BiTE) comprises a signal peptide. In certain embodiments, the signal peptide comprises the amino acid sequence of SEQ ID NO:19.

In some embodiments, the T-cell engager (TE or BiTE) comprises an amino acid sequence that is at least 60% identical to at least one amino acid sequence set forth in SEQ ID NO: 21-27, 109-111, 176-178 and 292. For example, the sequence identity can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In particular embodiments, the T-cell engager (TE or BiTE) comprises an amino acid sequence that is at least 90% (e.g., 91%, 92%, 93%, 94%, 95%, 96%, 97%, 98% or 99%) identical to at least one amino acid sequence set forth in SEQ ID NO: 21-27, 109-111, 176-178 and 292.

In some embodiments, the T-cell engager (TE or BiTE) comprises at least one amino acid substitution, relative to at least one amino acid sequence set forth in SEQ ID NO: 21-23 and 109-111. In some embodiments, the at least one amino acid substitution is at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions. In some embodiments, the at least one amino acid substitution is about 1-45 amino acid substitutions, for example, about: 1-40, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions. In certain embodiments, the at least one amino acid substitution is about 1-25 amino acid substitutions, for example, about: 1-22, 2-22, 2-20, 3-20, 3-18, 4-18, 4-16, 5-16, 5-14, 6-14, 6-12, 7-12, 7-10 or 8-10 amino acid substitutions. In particular embodiments, the at least one amino acid substitution is about 1-12 amino acid substitutions, for example, about: 1-11, 2-11, 2-10, 3-10, 3-9, 4-9, 4-8, 5-8, 5-7 or 6-7 amino acid substitutions. In certain embodiments, the T-cell engager (TE or BiTE) comprises about 1-40 amino acid substitutions, relative to at least one amino acid sequence set forth in SEQ ID NO: 21-23 and 109-111.

In some embodiments, the T-cell engager (TE or BiTE) comprises at least one amino acid substitution, relative to at least one amino acid sequence set forth in SEQ ID NO: 24-27, 176-178 and 292. In certain embodiments, the at least one amino acid substitution is at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65 or 70 amino acid substitutions. In some embodiments, the at least one amino acid substitution is about 1-70 amino acid substitutions, for example, about: 1-65, 1-60, 1-55, 5-55, 5-50, 10-50, 10-45, 15-45, 15-40, 20-40, 20-35, 25-35 or 25-30 amino acid substitutions. In certain embodiments, the T-cell engager (TE or BiTE) comprises about 1-55 amino acid substitutions, relative to at least one amino acid sequence set forth in SEQ ID NO: 24-27, 176-178 and 292. In particular embodiments, the T-cell engager (TE or BiTE) comprises the amino acid sequence of any one of SEQ ID NO: 24-27, 176-178 and 292.

In some embodiments, the polynucleotide encodes an amino acid sequence that is at least 60% identical to at least one amino acid sequence set forth in SEQ ID NOs: 31-38, SEQ ID NOs: 106-108, SEQ ID NOs: 112-119, SEQ ID NOs: 173-175, SEQ ID NOs: 179-186, SEQ ID NOs: 192-203, SEQ ID NOs: 222-237 or SEQ ID NOs: 239-241, or a combination thereof. For example, the sequence identity can be at least about: 65%, 70%, 75%, 80%, 85%, 90%, 91%, 92%, 93%, 94%, 95%, 96%, 97%, 98% or 99%. In certain embodiments, the sequence identity is about: 60%, 65%, 70%, 75%, 80%, 85%, 90%, 91%, 92%, 93%, 94%, 95%, 96%, 97%, 98% or 99%. In particular embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%.

In some embodiments, the polynucleotide encodes an amino acid sequence that is at least 90% (e.g., 91%, 92%, 93%, 94%, 95%, 96%, 97%, 98% or 99%) identical to at least one amino acid sequence independently selected from SEQ ID NOs: 31-38, SEQ ID NOs: 106-108, SEQ ID NOs: 112-119, SEQ ID NOs: 173-175, SEQ ID NOs: 179-186, SEQ ID NOs: 192-203, SEQ ID NOs: 222-237 or SEQ ID NOs: 239-241, or a combination thereof.

In certain embodiments, the polynucleotide encodes an amino acid sequence comprising at least one amino acid substitution, relative to at least one amino acid sequence independently selected from SEQ ID NOs: 31-38, SEQ ID NOs: 106-108, SEQ ID NOs: 112-119, SEQ ID NOs: 173-175, SEQ ID NOs: 179-186, SEQ ID NOs: 192-203, SEQ ID NOs: 222-237 or SEQ ID NOs: 239-241. In some embodiments, the at least one amino acid substitution is at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55 or 60 amino acid substitutions. In some embodiments, the at least one amino acid substitution is about 1-60 amino acid substitutions, for example, about: 1-55, 1-50, 1-45, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions. In certain embodiments, the polynucleotide encodes an amino acid sequence comprising about 1-50 amino acid substitutions, relative to at least one amino acid sequence independently selected from SEQ ID NOs: 31-38, SEQ ID NOs: 106-108, SEQ ID NOs: 112-119, SEQ ID NOs: 173-175, SEQ ID NOs: 179-186, SEQ ID NOs: 192-203, SEQ ID NOs: 222-237 or SEQ ID NOs: 239-241.

In particular embodiments, the polynucleotide encodes an amino acid sequence set forth in SEQ ID NOs: 31-38, SEQ ID NOs: 106-108, SEQ ID NOs: 112-119, SEQ ID NOs: 173-175, SEQ ID NOs: 179-186, SEQ ID NOs: 192-203, SEQ ID NOs: 222-237 or SEQ ID NOs: 239-241.

In one aspect, the disclosure provides a first polynucleotide and a second polynucleotide, wherein the first polynucleotide comprises a sequence encoding a chimeric antigen receptor (CAR) and the second polynucleotide comprises a T-cell engager (TE or BiTE), wherein the CAR is capable of binding to one or more first TAAs, and wherein the T-cell engager (TE or BiTE) is capable of binding to T-cell and a second TAA. In some embodiments, the first polynucleotide comprises a polynucleotide as defined herein. In some embodiments, the second polynucleotide comprises a polynucleotide as defined herein.

In another aspect, the disclosure provides a polynucleotide that comprises a sequence encoding a bi-specific CAR that is capable of binding to HER2 and IL13Rα2, wherein the bi-specific CAR comprises an IL13 mutein linked to a HER2-binding scFv via a linker sequence.

1. IL13 Mutein

In some embodiments, the IL13 mutein comprises the amino acid sequence of SEQ ID NO: 1 (Table 1).

In some embodiments, the IL13 mutein comprises, consists essentially of, or consists of an amino acid sequence that is at least 60% identical to the amino acid sequence of SEQ ID NO: 1. For example, the sequence identity to SEQ ID NO: 1 can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the IL13 mutein comprises an amino acid sequence that is at least 90% identical to the amino acid sequence of SEQ ID NO: 1.

In some embodiments, the IL13 mutein comprises at least one amino acid substitution, relative to SEQ ID NO: 1. In some embodiments, the IL13 mutein comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, relative to SEQ ID NO: 1. In some embodiments, the IL13 mutein comprises about 1-45 amino acid substitutions, relative to the amino acid sequence of SEQ ID NO: 1. In some embodiments, the IL13 mutein comprises about: 1-40, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions, relative to the amino acid sequence of SEQ ID NO: 1. In some embodiments, the IL13 mutein comprises about 1-12 amino acid substitutions, relative to the amino acid sequence of SEQ ID NO: 1. In some embodiments, the IL13 mutein comprises about: 1-11, 2-12, 2-11, 3-11, 3-10, 4-10, 4-9, 5-9, 5-8, 6-8 or 6-7 amino acid substitutions, relative to the amino acid sequence of SEQ ID NO: 1. In some embodiments, the IL13 mutein comprises up to about: 45, 40, 35, 30, 25, 20, 15, 10, 6 or 5 amino acid substitutions, relative to the amino acid sequence of SEQ ID NO: 1.

2. HER2-Binding ScFv

In some embodiments, the HER2-binding scFv comprises, consists essentially of, or consists of the amino acid sequence of SEQ ID NO: 2, 3 or 4 (Table 1). In some embodiments, the HER2-binding scFv comprises, consists essentially of, or consists of the amino acid sequence of SEQ ID NO: 4.

In some embodiments, the HER2-binding scFv comprises, consists essentially of, or consists of an amino acid sequence that is at least 60% identical to the amino acid sequence of SEQ ID NO: 2, 3 or 4, or a combination thereof. For example, the sequence identity to SEQ ID NO: 2, 3 or 4, or a combination thereof can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the HER2-binding scFv comprises an amino acid sequence that is at least 90% identical to the amino acid sequence of SEQ ID NO: 2, 3 or 4, or a combination thereof.

In some embodiments, the HER2-binding scFv comprises, consists essentially of, or consists of an amino acid sequence that is at least 60% identical to the amino acid sequence of SEQ ID NO: 4. For example, the sequence identity to SEQ ID NO: 4, can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the HER2-binding scFv comprises an amino acid sequence that is at least 90% identical to the amino acid sequence of SEQ ID NO: 4.

In some embodiments, the HER2-binding scFv comprises at least one amino acid substitution, relative to SEQ ID NO: 2, 3 or 4, or a combination thereof. In some embodiments, the HER2-binding scFv comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90 or 95 amino acid substitutions, relative to SEQ ID NO: 2, 3 or 4, or a combination thereof. In some embodiments, the HER2-binding scFv comprises about 1-95 amino acid substitutions, relative to the amino acid sequence of SEQ ID NO: 2, 3 or 4, or a combination thereof. In some embodiments, the HER2-binding scFv comprises about: 1-90, 2-95, 2-90, 4-90, 4-85, 6-85, 6-80, 8-80, 8-75, 10-75, 10-70, 15-70, 15-65, 20-65, 20-60, 25-60, 25-50, 30-50 or 30-40 amino acid substitutions, relative to the amino acid sequence of SEQ ID NO: 2, 3 or 4, or a combination thereof. In some embodiments, the HER2-binding scFv comprises about 1-25 amino acid substitutions, relative to the amino acid sequence of SEQ ID NO: 2, 3 or 4, or a combination thereof. In some embodiments, the HER2-binding scFv comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 2, 3 or 4, or a combination thereof. In some embodiments, the HER2-binding scFv comprises up to about: 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 2, 3 or 4, or a combination thereof. In some embodiments, the amino acid substitutions include at least one conservative substitution. In some embodiments, the amino acid substitutions include at least one highly conservative substitution.

In some embodiments, the HER2-binding scFv comprises at least one amino acid substitution, relative to SEQ ID NO: 4. In some embodiments, the HER2-binding scFv comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90 or 95 amino acid substitutions, relative to SEQ ID NO: 4. In some embodiments, the HER2-binding scFv comprises about 1-95 amino acid substitutions, relative to the amino acid sequence of SEQ ID NO: 4. In some embodiments, the HER2-binding scFv comprises about: 1-90, 2-95, 2-90, 4-90, 4-85, 6-85, 6-80, 8-80, 8-75, 10-75, 10-70, 15-70, 15-65, 20-65, 20-60, 25-60, 25-50, 30-50 or 30-40 amino acid substitutions, relative to the amino acid sequence of SEQ ID NO: 4. In some embodiments, the HER2-binding scFv comprises about 1-25 amino acid substitutions, relative to the amino acid sequence of SEQ ID NO: 4. In some embodiments, the HER2-binding scFv comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 4. In some embodiments, the HER2-binding scFv comprises up to about: 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 4. In some embodiments, the amino acid substitutions include at least one conservative substitution. In some embodiments, the amino acid substitutions include at least one highly conservative substitution.

3. Linker

In some embodiments, the linker comprises the amino acid sequence of SEQ ID NO: 5 (Table 1). In some embodiments, the linker comprises an amino acid sequence that is at least 90% (e.g., 91%, 92%, 93%, 94%, 95%, 96%, 97%, 98% or 99%) identical to the amino acid sequence of SEQ ID NO: 5. In some embodiments, the linker comprises at least one amino acid substitution (e.g., 1, 2 or 3 amino acid substitutions), relative to SEQ ID NO: 5. In some embodiments, the amino acid substitutions include at least one conservative substitution. In some embodiments, the amino acid substitutions include at least one highly conservative substitution.

4. CD8a Signal Peptide

In some embodiments, the CD8a signal peptide comprises the amino acid sequence of SEQ ID NO: 6 (Table 1). In some embodiments, the CD8a signal peptide comprises an amino acid sequence that is at least 90% (e.g., 91%, 92%, 93%, 94%, 95%, 96%, 97%, 98% or 99%) identical to the amino acid sequence of SEQ ID NO: 6. In some embodiments, the CD8a signal peptide comprises at least one amino acid substitution (e.g., 1, 2 or 3 amino acid substitutions), relative to SEQ ID NO: 6. In some embodiments, the amino acid substitutions include at least one conservative substitution. In some embodiments, the amino acid substitutions include at least one highly conservative substitution.

5. CD8α Hinge

In some embodiments, the CD8α hinge comprises the amino acid sequence of SEQ ID NO: 7 (Table 1). In some embodiments, the CD8α hinge comprises an amino acid sequence that is at least 80% (e.g., 81%, 82%, 83%, 84%, 85%, 86%, 87%, 88%, 89%, 90%, 91%, 92%, 93%, 94%, 95%, 96%, 97%, 98% or 99%) identical to the amino acid sequence of SEQ ID NO: 7. In some embodiments, the CD8α hinge comprises an amino acid sequence that is at least 90% identical to the amino acid sequence of SEQ ID NO: 7. In some embodiments, the CD8α hinge comprises at least one amino acid substitution (e.g., 1, 2, 3, 4 or 5 amino acid substitutions), relative to SEQ ID NO: 7. In some embodiments, the amino acid substitutions include at least one conservative substitution. In some embodiments, the amino acid substitutions include at least one highly conservative substitution.

6. CD28 Transmembrane Domain

In some embodiments, the CD28 transmembrane domain comprises the amino acid sequence of SEQ ID NO: 8 (Table 1). In some embodiments, the CD28 transmembrane domain comprises an amino acid sequence that is at least 90% (e.g., 91%, 92%, 93%, 94%, 95%, 96%, 97%, 98% or 99%) identical to the amino acid sequence of SEQ ID NO: 8. In some embodiments, the CD28 transmembrane domain comprises at least one amino acid substitution (e.g., 1, 2 or 3 amino acid substitutions), relative to SEQ ID NO: 8. In some embodiments, the amino acid substitutions include at least one conservative substitution. In some embodiments, the amino acid substitutions include at least one highly conservative substitution.

7. 4-1BB Costimulatory Domain

In some embodiments, the 4-1BB costimulatory domain comprises the amino acid sequence of SEQ ID NO: 9 (Table 1). In some embodiments, the 4-1BB costimulatory domain comprises an amino acid sequence that is at least 90% (e.g., 91%, 92%, 93%, 94%, 95%, 96%, 97%, 98% or 99%) identical to the amino acid sequence of SEQ ID NO: 9. In some embodiments, the 4-1BB costimulatory domain comprises at least one amino acid substitution (e.g., 1, 2, 3 or 4 amino acid substitutions), relative to SEQ ID NO: 9. In some embodiments, the amino acid substitutions include at least one conservative substitution. In some embodiments, the amino acid substitutions include at least one highly conservative substitution.

8. CD3ζ Signaling Domain

In some embodiments, the CD3ζ signaling domain comprises the amino acid sequence of SEQ ID NO: 10 (Table 1).

In some embodiments, the CD3ζ signaling domain comprises an amino acid sequence that is at least 60% identical to the amino acid sequence of SEQ ID NO: 10. For example, the sequence identity to SEQ ID NO: 10 can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the CD3ζ signaling domain comprises an amino acid sequence that is at least 90% identical to the amino acid sequence of SEQ ID NO: 10.

In some embodiments, the CD3ζ signaling domain comprises at least one amino acid substitution, relative to SEQ ID NO: 10. In some embodiments, the CD3ζ signaling domain comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, relative to SEQ ID NO: 10. In some embodiments, the CD3ζ signaling domain comprises about 1-45 amino acid substitutions, relative to the amino acid sequence of SEQ ID NO: 10. In some embodiments, the CD3ζ signaling domain comprises about: 1-40, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions, relative to the amino acid sequence of SEQ ID NO: 10. In some embodiments, the CD3ζ signaling domain comprises about 1-12 amino acid substitutions, relative to the amino acid sequence of SEQ ID NO: 10. In some embodiments, the CD3ζ signaling domain comprises about: 1-11, 2-12, 2-11, 3-11, 3-10, 4-10, 4-9, 5-9, 5-8, 6-8 or 6-7 amino acid substitutions, relative to the amino acid sequence of SEQ ID NO: 10. In some embodiments, the CD3ζ signaling domain comprises up to about: 45, 40, 35, 30, 25, 20, 15, 10, 6 or 5 amino acid substitutions, relative to the amino acid sequence of SEQ ID NO: 10. In some embodiments, the amino acid substitutions include at least one conservative substitution. In some embodiments, the amino acid substitutions include at least one highly conservative substitution.

In some embodiments:
the IL13 mutein comprises an amino acid sequence that is at least 90% identical to the amino acid sequence of SEQ ID NO: 1;
the HER2-binding scFv comprises an amino acid sequence that is at least 90% identical to the amino acid sequence of SEQ ID NO: 2, 3 or 4, or a combination thereof;
the CD8α signal peptide comprises an amino acid sequence that is at least 90% identical to the amino acid sequence of SEQ ID NO: 6;
the CD8α hinge comprises an amino acid sequence that is at least 90% identical to the amino acid sequence of SEQ ID NO: 7;
the CD28 transmembrane domain comprises an amino acid sequence that is at least 90% identical to the amino acid sequence of SEQ ID NO: 8;
the 4-1BB costimulatory domain comprises an amino acid sequence that is at least 90% identical to the amino acid sequence of SEQ ID NO: 9; or
the CD3ζ signaling domain comprises an amino acid sequence that is at least 90% identical to the amino acid sequence of SEQ ID NO: 10, or a combination thereof.

In some embodiments:
the IL13 mutein comprises about 1-12 amino acid substitutions, relative to the amino acid sequence of SEQ ID NO: 1;
the HER2-binding scFv comprises about 1-25 amino acid substitutions, relative to the amino acid sequence of SEQ ID NO: 2, 3 or 4, or a combination of thereof, the CD8α signal peptide comprises about 1 or 2 amino acid substitutions, relative to the amino acid sequence of SEQ ID NO: 6;

the linker comprises about 1 or 2 amino acid substitutions, relative to the amino acid sequence of SEQ ID NO: 3;

the CD8α hinge comprises about 1-5 amino acid substitutions, relative to the amino acid sequence of SEQ ID NO: 7;

the CD28 transmembrane domain comprises about 1-3 amino acid substitutions, relative to the amino acid sequence of SEQ ID NO: 8;

the 4-1BB costimulatory domain comprises about 1-5 amino acid substitutions, relative to the amino acid sequence of SEQ ID NO: 9; or the CD3ζ signaling domain comprises about 1-12 amino acid substitutions, relative to the amino acid sequence of SEQ ID NO: 10, or a combination thereof.

In some embodiments, the CD8α signal peptide is N-terminal to IL13 mutein, which is N-terminal to the linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain (FIG. 1).

In some embodiments, the bi-specific CAR comprises the amino acid sequence of SEQ ID NO: 11, 12 or 13 (Table 1).

In some embodiments, the bi-specific CAR comprises an amino acid sequence that is at least 60% identical to the amino acid sequence of SEQ ID NO: 11, 12 or 13, or a combination thereof. For example, the sequence identity to SEQ ID NO: 11, 12 or 13, or a combination thereof can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the bi-specific CAR comprises an amino acid sequence that is at least 80%, 85%, 90%, 95%, 98%, or 99% identical to the amino acid sequence of SEQ ID NO: 11, 12 or 13, or a combination thereof.

In some embodiments, the bi-specific CAR comprises at least one amino acid substitution, relative to SEQ ID NO: 11, 12 or 13, or a combination thereof. In some embodiments, the bi-specific CAR comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90, 95, 100, 110 or 120 amino acid substitutions, relative to SEQ ID NO: 11, 12 or 13, or a combination thereof. In some embodiments, the bi-specific CAR comprises about 1-120 amino acid substitutions, relative to the amino acid sequence of SEQ ID NO: 11, 12 or 13, or a combination thereof. In some embodiments, the bi-specific CAR comprises about: 1-110, 2-110, 2-100, 4-100, 4-90, 6-90, 6-80, 8-80, 8-70, 10-70, 10-60, 15-60, 15-50, 20-50, 20-40, 25-40 or 25-30 amino acid substitutions, relative to the amino acid sequence of SEQ ID NO: 11, 12 or 13, or a combination thereof. In some embodiments, the bi-specific CAR comprises about 1-60 amino acid substitutions, relative to the amino acid sequence of SEQ ID NO: 11, 12 or 13, or a combination thereof. In some embodiments, the bi-specific CAR comprises about 1-25 amino acid substitutions, relative to the amino acid sequence of SEQ ID NO: 11, 12 or 13, or a combination thereof. In some embodiments, the bi-specific CAR comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 11, 12 or 13, or a combination thereof. In some embodiments, the bi-specific CAR comprises up to about: 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 11, 12 or 13, or a combination thereof. In some embodiments, the amino acid substitutions include at least one conservative substitution. In some embodiments, the amino acid substitutions include at least one highly conservative substitution.

B. Polynucleotides Encoding T-Cell Engagers (TEs or BiTEs)

In another aspect, the disclosure provides a polynucleotide that comprises a sequence encoding a T-cell engager (TE or BiTE) that is capable of binding to a T cell, a first TAA epitope, and a second TAA epitope. In some embodiments, the first TAA epitope and the second TAA epitope are on a second TAA. In some embodiments, the first TAA epitope and the second TAA epitope are on two second TAAs.

In some embodiments, the T-cell engager (TE or BiTE) is capable of binding to CD2, CD3, VLA-1, CD8, CD4, CCR6, CXCR5, CD25, CD31, CD45RO, CD197, CD127, CD38, CD27, CD196, CD277, or CXCR3. In certain embodiments, the T-cell engager (TE or BiTE) is capable of binding to CD2, CD3, CD31, or CD277. In particular embodiments, the T-cell engager is capable of binding to CD3. In some embodiments, the T-cell engager (TE or BiTE) is capable of binding to CD3.

In some embodiments, the T-cell engager (TE or BiTE) comprises a first binding moiety and a second binding moiety. In certain embodiments, the first binding moiety is capable of binding to a surface antigen on T-cell. In certain embodiments, the second binding moiety is capable of binding to a first TAA. In certain embodiments, the T-cell engager (TE or BiTE) comprises a third binding moiety and the third binding moiety is capable of binding to a second TAA. In certain embodiments, the first TAA and the second TAA are the same. In certain embodiments, the first binding moiety and the second binding moiety are capable of binding to two different epitopes. In some embodiments, the first TAA and the second TAA are different.

In some embodiments, the TAA is CEA, GPC3, MUC-1, EpCAM, HER receptors, PEM, A33, G250, carbohydrate antigens Ley, Lex, Leb, PSMA, TAG-72, STEAP1, CD166, CD24, CD44, E-cadherin, SPARC, ErbB2, ErbB3, WT1, MUC1, LMP2, idiotype, HPV E6&E7, EGFR, EGFRvIII, HER-2/neu, MAGE A3, p53 nonmutant, p53 mutant, NY-ESO-1, GD2, PSMA, PCSA, PSA, MelanA/MART1, Ras mutant, proteinase3 (PR1), bcr-abl, tyrosinase, survivin, PSA, or hTERT. In some embodiments, the TAA is a glioblastoma tumor antigen. In certain embodiments, the TAA is HER2, GPC3, EGFR, or EGFRvIII. In particular embodiments, the TAA is HER2. In particular embodiments, the TAA is GPC3. In particular embodiments, the TAA is EFGR. In particular embodiments, the TAA is EGFRvIII.

In some embodiments, the T-cell engager (TE or BiTE) comprises a CD3-binding scFv.

In some embodiments, the T-cell engager (TE or BiTE) comprises at least one EGFR-binding nanobody. In some embodiments, the T-cell engager (TE or BiTE) comprises at least one EGFRvIII-binding nanobody. In some embodiments, the T-cell engager (TE or BiTE) comprises at least one GPC3-binding nanobody. In some embodiments, the T-cell engager (TE or BiTE) comprises two EGFR-binding nanobodies. In some embodiments, the T-cell engager (TE or BiTE) comprises two EGFRvIII-binding nanobodies. In some embodiments, the T-cell engager (TE or BiTE) comprises two GPC3-binding nanobodies. In some embodiments, the T-cell engager (TE or BiTE) comprises one EGFR-binding nanobody and one EGFRvIII-binding nanobody. In some embodiments, the T-cell engager (TE or BiTE) comprises one EGFR-binding nanobody and one GPC3-binding nanobody. In some embodiments, the T-cell engager (TE or BiTE) comprises one GPC3-binding nanobody and one EGFRvIII-binding nanobody.

In some embodiments, the T-cell engager (TE or BiTE) comprises a linker, a signal peptide or a peptide tag, or a combination thereof.

In some embodiments, the polynucleotide is isolated (e.g., produced synthetically or via molecular cloning). In some embodiments, the polynucleotide is integrated into the genomic DNA of a host cell (e.g., a T lymphocyte). In some embodiments, the polynucleotide is extrachromosomal (e.g., on a plasmid, on a viral vector) within a host cell. In some embodiments, the polynucleotide is a DNA. In some embodiments, the polynucleotide is a RNA. The polynucleotide can be inserted into a plasmid or vector, such as a viral vector (e.g., a lentiviral vector). In addition, the polynucleotide can include one or more modified nucleotides (e.g., one or more chemically modified nucleotides).

In some embodiments, the first nanobody and the second nanobody each independently comprises an amino acid sequence that is at least 60% identical to at least one amino acid sequence set forth in SEQ ID NOs: 24-27, 176-178 and 292. For example, the sequence identity can be at least about: 65%, 70%, 75%, 80%, 85%, 90%, 91%, 92%, 93%, 94%, 95%, 96%, 97%, 98% or 99%. In certain embodiments, the sequence identity is about: 60%, 65%, 70%, 75%, 80%, 85%, 90%, 91%, 92%, 93%, 94%, 95%, 96%, 97%, 98% or 99%. In certain embodiments, the first nanobody, the second nanobody, or both comprise an amino acid sequence that is at least 90% (e.g., 91%, 92%, 93%, 94%, 95%, 96%, 97%, 98% or 99%) identical to at least one amino acid sequence set forth in SEQ ID NOs: 24-27, 176-178 and 292.

In some embodiments, the first nanobody and the second nanobody each independently comprises an amino acid sequence having at least one amino acid substitution, relative to at least one amino acid sequence set forth in SEQ ID NOs: 24-27, 176-178 and 292. In some embodiments, the at least one amino acid substitution is at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55 or 60 amino acid substitutions. In some embodiments, the at least one amino acid substitution is about 1-60 amino acid substitutions, for example, about: 1-55, 1-50, 1-45, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions. In certain embodiments, the first nanobody, the second nanobody, or both comprise an amino acid sequence having at least one bout 1-50 amino acid substitutions, relative to at least one amino acid sequence set forth in SEQ ID NOs: 24-27, 176-178 and 292.

In particular embodiments, the first nanobody and the second nanobody each independently comprises an amino acid sequence set forth in SEQ ID NOs: 24-27, 176-178 and 292.

1. CD3-Binding ScFv

In some embodiments, the CD3-binding scFv comprises the amino acid sequence of SEQ ID NO: 14 (Table 2).

In some embodiments, the CD3-binding scFv comprises an amino acid sequence that is at least 60% identical to the amino acid sequence of SEQ ID NO: 14. For example, the sequence identity to SEQ ID NO: 14 can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the CD3-binding scFv comprises an amino acid sequence that is at least 90% identical to the amino acid sequence of SEQ ID NO: 14.

In some embodiments, the CD3-binding scFv comprises at least one amino acid substitution, relative to SEQ ID NO: 14. In some embodiments, the CD3-binding scFv comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90 or 95 amino acid substitutions, relative to SEQ ID NO: 14. In some embodiments, the CD3-binding scFv comprises about 1-95 amino acid substitutions, relative to the amino acid sequence of SEQ ID NO: 14. In some embodiments, the CD3-binding scFv comprises about: 1-90, 2-95, 2-90, 4-90, 4-85, 6-85, 6-80, 8-80, 8-75, 10-75, 10-70, 15-70, 15-65, 20-65, 20-60, 25-60, 25-50, 30-50 or 30-40 amino acid substitutions, relative to the amino acid sequence of SEQ ID NO: 14. In some embodiments, the CD3-binding scFv comprises about 1-25 amino acid substitutions, relative to the amino acid sequence of SEQ ID NO: 14. In some embodiments, the CD3-binding scFv comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 14. In some embodiments, the CD3-binding scFv comprises up to about: 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 14. In some embodiments, the amino acid substitutions include at least one conservative substitution. In some embodiments, the amino acid substitutions include at least one highly conservative substitution.

2. Tumor Associated Antigen (TAA)

In some embodiments, the TAA is a glioblastoma tumor antigen.

In some embodiments, the glioblastoma tumor antigen is EGFR.

In some embodiments, the T-cell engager (TE or BiTE) comprises at least one EGFR-binding nanobody.

In some embodiments, the EGFR-binding nanobody comprises the amino acid sequence of SEQ ID NO: 15, 16 or 17 (Table 2).

In some embodiments, the EGFR-binding nanobody comprises an amino acid sequence that is at least 60% identical to the amino acid sequence of SEQ ID NO: 15, 16 or 17, or a combination thereof. For example, the sequence identity to SEQ ID NO: 15, 16 or 17, or a combination thereof can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the EGFR-binding nanobody comprises an amino acid sequence that is at least 90% identical to the amino acid sequence of SEQ ID NO: 15, 16 or 17, or a combination thereof.

In some embodiments, the EGFR-binding nanobody comprises at least one amino acid substitution, relative to SEQ ID NO: 15, 16 or 17, or a combination thereof. In some embodiments, the EGFR-binding nanobody comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, relative to SEQ ID NO: 15, 16 or 17, or a combination thereof. In some embodiments, the EGFR-binding nanobody comprises about 1-45 amino acid substitutions, relative to the amino acid sequence of SEQ ID NO: 15, 16 or 17, or a combination thereof. In some embodiments, the EGFR-binding nanobody comprises about: 1-40, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions, relative to the amino acid sequence of SEQ ID NO: 15, 16 or 17, or a combination thereof. In some embodiments, the EGFR-binding nanobody comprises about 1-12 amino acid substitutions, relative to the amino acid sequence of SEQ ID NO: 15, 16 or 17, or a combination thereof. In some embodiments, the EGFR-binding nanobody comprises about: 1-11, 2-12, 2-11, 3-11, 3-10, 4-10, 4-9, 5-9, 5-8, 6-8 or 6-7 amino acid substitutions, relative to the amino acid sequence of SEQ ID NO: 15, 16 or 17, or a combination thereof. In some embodiments, the EGFR-binding nanobody comprises up to about: 45, 40, 35, 30, 25, 20, 15, 10, 6 or 5 amino acid substitutions, relative to the amino acid sequence of SEQ ID NO: 15, 16 or 17, or a combination thereof. In some embodiments, the amino acid substitutions include at least one conservative substitution. In some embodiments, the amino acid substitutions include at least one highly conservative substitution.

In some embodiments, the glioblastoma cancer is EGFRvIII.

In some embodiments, the T-cell engager (TE or BiTE) comprises at least one EGFRvIII-binding nanobody.

In some embodiments, the EGFRvIII-binding nanobody comprises the amino acid sequence of SEQ ID NO: 15, 16 or 17 (Table 2).

In some embodiments, the EGFRvIII-binding nanobody comprises an amino acid sequence that is at least 60% identical to the amino acid sequence of SEQ ID NO: 15, 16 or 17, or a combination thereof. For example, the sequence identity to SEQ ID NO: 15, 16 or 17, or a combination thereof can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the EGFRvIII-binding nanobody comprises an amino acid sequence that is at least 90% identical to the amino acid sequence of SEQ ID NO: 15, 16 or 17, or a combination thereof.

In some embodiments, the EGFRvIII-binding nanobody comprises at least one amino acid substitution, relative to SEQ ID NO: 15, 16 or 17, or a combination thereof. In some embodiments, the EGFRvIII-binding nanobody comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, relative to SEQ ID NO: 15, 16 or 17, or a combination thereof. In some embodiments, the EGFRvIII-binding nanobody comprises about 1-45 amino acid substitutions, relative to the amino acid sequence of SEQ ID NO: 15, 16 or 17, or a combination thereof. In some embodiments, the EGFRvIII-binding nanobody comprises about: 1-40, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions, relative to the amino acid sequence of SEQ ID NO: 15, 16 or 17, or a combination thereof. In some embodiments, the EGFRvIII-binding nanobody comprises about 1-12 amino acid substitutions, relative to the amino acid sequence of SEQ ID NO: 15, 16 or 17, or a combination thereof. In some embodiments, the EGFRvIII-binding nanobody comprises about: 1-11, 2-12, 2-11, 3-11, 3-10, 4-10, 4-9, 5-9, 5-8, 6-8 or 6-7 amino acid substitutions, relative to the amino acid sequence of SEQ ID NO: 15, 16 or 17, or a combination thereof. In some embodiments, the EGFRvIII-binding nanobody comprises up to about: 45, 40, 35, 30, 25, 20, 15, 10, 6 or 5 amino acid substitutions, relative to the amino acid sequence of SEQ ID NO: 15, 16 or 17, or a combination thereof. In some embodiments, the amino acid substitutions include at least one conservative substitution. In some embodiments, the amino acid substitutions include at least one highly conservative substitution.

In some embodiments, the T-cell engager (TE or BiTE) comprises at least one GPC3-binding nanobody.

In some embodiments, the GPC3-binding nanobody comprises the amino acid sequence of any one of SEQ ID NO: 282-291. In particular embodiments, the GPC3-binding nanobody comprises the amino acid sequence of SEQ ID NO: 284, 286 or 289.

In some embodiments, the GPC3-binding nanobody comprises an amino acid sequence that is at least 60% identical to the amino acid sequence of any one of SEQ ID NO: 282-291, or a combination thereof. For example, the sequence identity to any one of SEQ ID NO: 282-291, or a combination thereof can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the GPC3-binding nanobody comprises an amino acid sequence that is at least 90% identical to the amino acid sequence of any one of SEQ ID NO: 282-291, or a combination thereof.

In some embodiments, the GPC3-binding nanobody comprises at least one amino acid substitution, relative to any one of SEQ ID NO: 282-291, or a combination thereof. In some embodiments, the GPC3-binding nanobody comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44 or 45 amino acid substitutions, relative to any one of SEQ ID NO: 282-291, or a combination thereof. In some embodiments, the GPC3-binding nanobody comprises about 1-45 amino acid substitutions, relative to the amino acid sequence of any one of SEQ ID NO: 282-291, or a combination thereof. In some embodiments, the GPC3-binding nanobody comprises about: 1-40, 2-45, 2-40, 3-40, 3-35, 4-35, 4-30, 5-30, 5-25, 6-25, 6-20, 7-20, 7-15, 8-15, 8-14, 9-14, 9-12 or 10-12 amino acid substitutions, relative to the amino acid sequence of any one of SEQ ID NO: 282-291, or a combination thereof. In some embodiments, the GPC3-binding nanobody comprises about 1-12 amino acid substitutions, relative to the amino acid sequence of any one of SEQ ID NO: 282-291, or a combination thereof. In some embodiments, the GPC3-binding nanobody comprises about: 1-11, 2-12, 2-11, 3-11, 3-10, 4-10, 4-9, 5-9, 5-8, 6-8 or 6-7 amino acid substitutions, relative to the amino acid sequence of any one of SEQ ID NO: 282-291, or a combination thereof. In some embodiments, the GPC3-binding nanobody comprises up to about: 45, 40, 35, 30, 25, 20, 15, 10, 6 or 5 amino acid substitutions, relative to the amino acid sequence of any one of SEQ ID NO: 282-291, or a combination thereof. In some embodiments, the amino acid substitutions include at least one conservative substitution. In some embodiments, the amino acid substitutions include at least one highly conservative substitution.

3. Linker

In some embodiments, the T-cell engager (TE or BiTE) comprises at least one EGFR-binding nanobody or EGFR-binding scFv linked to a CD3-binding scFv via a linker sequence. In some embodiments, the T-cell engager (TE or BiTE) comprises at least one EGFRvIII-binding nanobody or EGFRvIII-binding scFv linked to a CD3-binding scFv via a linker sequence. In some embodiments, the linker sequence comprises GGGGS (SEQ ID NO: 18) (Table 2).

In some embodiments, the T-cell engager (TE or BiTE) comprises at least one GPC3-binding nanobody or GPC3-binding scFv linked to a CD3-binding scFv via a linker sequence.

4. Signal Peptide

In some embodiments, the T-cell engager (TE or BiTE) comprises a signal peptide. In some embodiments, the signal peptide comprises an amino acid sequence that is at least 90% identical to the amino acid sequence of SEQ ID NO: 19 (Table 2).

In some embodiments, the signal peptide comprises the amino acid sequence of SEQ ID NO: 19. In some embodiments, the signal peptide comprises an amino acid sequence that is at least 90% (e.g., 91%, 92%, 93%, 94%, 95%, 96%, 97%, 98% or 99%) identical to the amino acid sequence of SEQ ID NO: 19. In some embodiments, the signal peptide comprises at least one amino acid substitution (e.g., 1, 2 or 3 amino acid substitutions), relative to SEQ ID NO: 19. In some embodiments, the amino acid substitutions include at least one conservative substitution. In some embodiments, the amino acid substitutions include at least one highly conservative substitution.

5. Peptide Tag

In some embodiments, the peptide tag comprises a polyhistidine sequence, for example, 6× His (SEQ ID NO: 20) (Table 2).

6. Configurations

Figure 6:
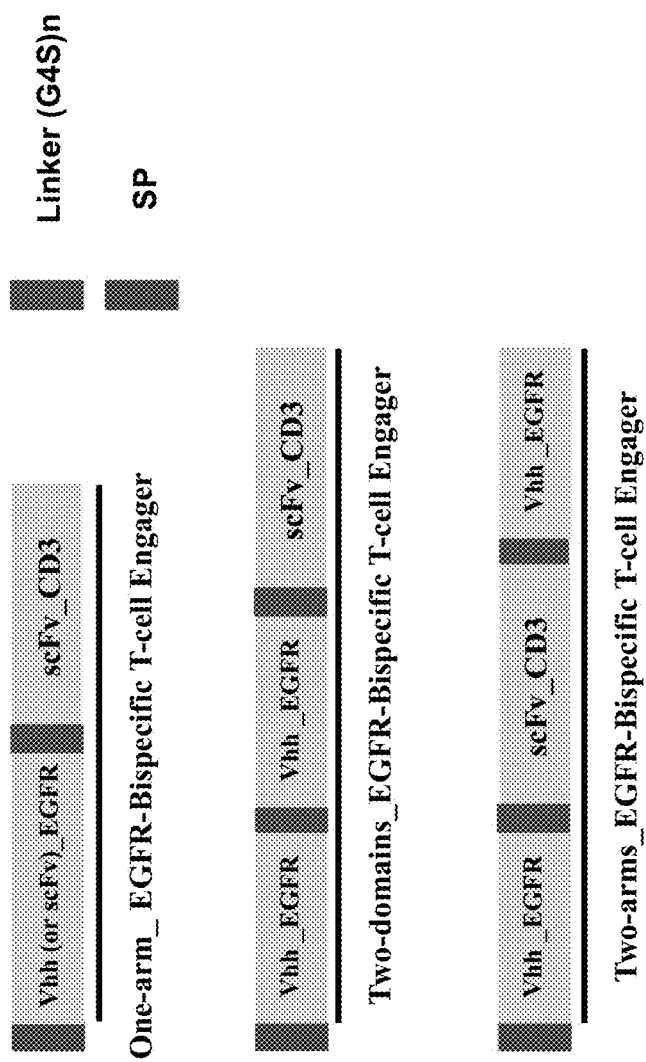
FIG. 6 is a graphic representation of non-limiting examples of T-cell engager structures of the disclosure.

In some embodiments, the T-cell engager (TE or BiTE) comprises one EGFR-binding nanobody. In some embodiments, the signal peptide is N-terminal to the EGFR-binding nanobody, which is N-terminal to the linker, which is N-terminal to the CD3-binding scFv (FIG. 6, top panel).

In some embodiments, the T-cell engager (TE or BiTE) comprises one EGFRvIII-binding nanobody. In some embodiments, the signal peptide is N-terminal to the EGFRvIII-binding nanobody, which is N-terminal to the linker, which is N-terminal to the CD3-binding scFv (FIG. 6, top panel).

In some embodiments, the T-cell engager (TE or BiTE) comprises one GPC3-binding nanobody. In some embodiments, the signal peptide is N-terminal to the GPC3-binding nanobody, which is N-terminal to the linker, which is N-terminal to the CD3-binding scFv (FIG. 6, top panel).

In some embodiments, the T-cell engager (TE or BiTE) comprises the amino acid sequence of SEQ ID NO: 21, 22, 23 (Table 2), 109, 110 or 111.

In some embodiments, the T-cell engager (TE or BiTE) comprises an amino acid sequence that is at least 60% identical to the amino acid sequence of SEQ ID NO: 21, 22, 23, 109, 110 or 111, or a combination thereof. For example, the sequence identity to SEQ ID NO: 21, 22, 23, 109, 110 or 111, or a combination thereof can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the T-cell engager (TE or BiTE) comprises an amino acid sequence that is at least 80%, 85%, 90%, 95%, 98%, or 99% identical to the amino acid sequence of SEQ ID NO: 21, 22, 23, 109, 110 or 111, or a combination thereof.

In some embodiments, the T-cell engager (TE or BiTE) comprises at least one amino acid substitution, relative to SEQ ID NO: 21, 22, 23, 109, 110 or 111, or a combination thereof. In some embodiments, the T-cell engager (TE or BiTE) comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90, 95, 100, 110, 120, 130, 140, 150 or 160 amino acid substitutions, relative to SEQ ID NO: 21, 22, 23, 109, 110 or 111, or a combination thereof. In some embodiments, the T-cell engager (TE or BiTE) comprises about 1-160 amino acid substitutions, relative to the amino acid sequence of SEQ ID NO: 21, 22, 23, 109, 110 or 111, or a combination thereof. In some embodiments, the T-cell engager (TE or BiTE) comprises about: 1-140, 2-160, 2-140, 4-140, 4-120, 6-120, 6-100, 8-100, 8-80, 10-80, 10-60, 15-60, 15-50, 20-50, 20-40, 25-40 or 25-30 amino acid substitutions, relative to the amino acid sequence of SEQ ID NO: 21, 22, 23, 109, 110 or 111, or a combination thereof. In some embodiments, the T-cell engager (TE or BiTE) comprises about 1-60 amino acid substitutions, relative to the amino acid sequence of SEQ ID NO: 21, 22, 23, 109, 110 or 111, or a combination thereof. In some embodiments, the T-cell engager (TE or BiTE) comprises about 1-25 amino acid substitutions, relative to the amino acid sequence of SEQ ID NO: 21, 22, 23, 109, 110 or 111, or a combination thereof. In some embodiments, the T-cell engager (TE or BiTE) comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 21, 22, 23, 109, 110 or 111, or a combination thereof. In some embodiments, the T-cell engager (TE or BiTE) comprises up to about: 160, 150, 140, 130, 120, 110, 100, 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 21, 22, 23, 109, 110 or 111, or a combination thereof. In some embodiments, the amino acid substitutions include at least one conservative substitution. In some embodiments, the amino acid substitutions include at least one highly conservative substitution.

In some embodiments, the T-cell engager (TE or BiTE) comprises one EGFR-binding scFv. In some embodiments, the signal peptide is N-terminal to the EGFR-binding scFv, which is N-terminal to the linker, which is N-terminal to the CD3-binding scFv (FIG. 6, top panel).

In some embodiments, the T-cell engager (TE or BiTE) comprises at least two EGFR-binding nanobodies. In some embodiments, the T-cell engager (TE or BiTE) comprises two EGFR-binding nanobodies. In some embodiments, the signal peptide is N-terminal to the first EGFR-binding nanobody, which is N-terminal to the first linker, which is N-terminal to the second EGFR-binding nanobody, which is N-terminal to the second linker, which is N-terminal to the CD3-binding scFv (FIG. 6, middle panel).

In some embodiments, the T-cell engager (TE or BiTE) comprises one EGFRvIII-binding scFv. In some embodiments, the signal peptide is N-terminal to the EGFRvIII-binding scFv, which is N-terminal to the linker, which is N-terminal to the CD3-binding scFv (FIG. 6, top panel).

In some embodiments, the T-cell engager (TE or BiTE) comprises at least two EGFRvIII-binding nanobodies. In some embodiments, the T-cell engager (TE or BiTE) comprises two EGFRvIII-binding nanobodies. In some embodiments, the signal peptide is N-terminal to the first EGFRvIII-binding nanobody, which is N-terminal to the first linker, which is N-terminal to the second EGFRvIII-binding nanobody, which is N-terminal to the second linker, which is N-terminal to the CD3-binding scFv (FIG. 6, middle panel).

In some embodiments, the T-cell engager (TE or BiTE) comprises at least one EGFR-binding nanobody and at least one EGFRvIII-binding nanobody. In some embodiments, the signal peptide is N-terminal to the EGFR-binding nanobody, which is N-terminal to the first linker, which is N-terminal to the EGFRvIII-binding nanobody, which is N-terminal to the second linker, which is N-terminal to the CD3-binding scFv. In some embodiments, the signal peptide is N-terminal to the EGFRvIII-binding nanobody, which is N-terminal to the first linker, which is N-terminal to the EGFR-binding nanobody, which is N-terminal to the second linker, which is N-terminal to the CD3-binding scFv.

In some embodiments, the T-cell engager (TE or BiTE) comprises one GPC3-binding scFv. In some embodiments, the signal peptide is N-terminal to the GPC3-binding scFv, which is N-terminal to the linker, which is N-terminal to the CD3-binding scFv (FIG. 6, top panel).

In some embodiments, the T-cell engager (TE or BiTE) comprises at least two GPC3-binding nanobodies. In some embodiments, the T-cell engager (TE or BiTE) comprises two GPC3-binding nanobodies. In some embodiments, the signal peptide is N-terminal to the first GPC3-binding nanobody, which is N-terminal to the first linker, which is N-terminal to the second GPC3-binding nanobody, which is N-terminal to the second linker, which is N-terminal to the CD3-binding scFv (FIG. 6, middle panel).

In some embodiments, the T-cell engager (TE or BiTE) comprises the amino acid sequence of SEQ ID NO: 24, 25 (Table 2), 176 or 177.

In some embodiments, the T-cell engager (TE or BiTE) comprises an amino acid sequence that is at least 60% identical to the amino acid sequence of SEQ ID NO: 24, 25, 176 or 177, or a combination thereof. For example, the sequence identity to SEQ ID NO: 24, 25, 176 or 177, or a combination thereof can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the T-cell engager (TE or BiTE) comprises an amino acid sequence that is at least 80%, 85%, 90%, 95%, 98%, or 99% identical to the amino acid sequence of SEQ ID NO: 24, 25, 176 or 177, or a combination thereof.

In some embodiments, the T-cell engager (TE or BiTE) comprises at least one amino acid substitution, relative to SEQ ID NO: 24, 25, 176 or 177, or a combination thereof. In some embodiments, the T-cell engager (TE or BiTE) comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90, 95, 100, 110, 120, 130, 140, 150, 160, 170. 180, 190, 200 or 210 amino acid substitutions, relative to SEQ ID NO: 24, 25, 176 or 177, or a combination thereof. In some embodiments, the T-cell engager (TE or BiTE) comprises about 1-210 amino acid substitutions, relative to the amino acid sequence of SEQ ID NO: 24, 25, 176 or 177, or a combination thereof. In some embodiments, the T-cell engager (TE or BiTE) comprises about: 1-200, 2-210, 2-200, 4-200, 4-180, 6-180, 6-160, 8-160, 8-140, 10-140, 10-120, 15-120, 15-100, 20-100, 20-80, 25-80, 25-60, 30-60 or 30-40 amino acid substitutions, relative to the amino acid sequence of SEQ ID NO: 24, 25, 176 or 177, or a combination thereof. In some embodiments, the T-cell engager (TE or BiTE) comprises about 1-60 amino acid substitutions, relative to the amino acid sequence of SEQ ID NO: 24, 25, 176 or 177, or a combination thereof. In some embodiments, the T-cell engager (TE or BiTE) comprises about 1-25 amino acid substitutions, relative to the amino acid sequence of SEQ ID NO: 24, 25, 176 or 177, or a combination thereof. In some embodiments, the T-cell engager (TE or BiTE) comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 24, 25, 176 or 177, or a combination thereof. In some embodiments, the T-cell engager (TE or BiTE) comprises up to about: 160, 150, 140, 130, 120, 110, 100, 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 24, 25, 176 or 177, or a combination thereof. In some embodiments, the amino acid substitutions include at least one conservative substitution. In some embodiments, the amino acid substitutions include at least one highly conservative substitution.

In some embodiments, the T-cell engager (TE or BiTE) comprises at least two EGFR-binding scFv. In some embodiments, the T-cell engager (TE or BiTE) comprises two EGFR-binding scFv. In some embodiments, the signal peptide is N-terminal to the first EGFR-binding scFv, which is N-terminal to the first linker, which is N-terminal to the second EGFR-binding scFv, which is N-terminal to the second linker, which is N-terminal to the CD3-binding scFv.

In some embodiments, the T-cell engager (TE or BiTE) comprises at least two EGFRvIII-binding scFv. In some embodiments, the T-cell engager (TE or BiTE) comprises two EGFRvIII-binding scFv. In some embodiments, the signal peptide is N-terminal to the first EGFRvIII-binding scFv, which is N-terminal to the first linker, which is N-terminal to the second EGFRvIII-binding scFv, which is N-terminal to the second linker, which is N-terminal to the CD3-binding scFv.

In some embodiments, the T-cell engager (TE or BiTE) comprises at least one EGFR-binding scFv and at least one EGFRvIII-binding scFv. In some embodiments, the T-cell engager (TE or BiTE) comprises one EGFR-binding scFv and one EGFRvIII-binding scFv. In some embodiments, the signal peptide is N-terminal to the EGFR-binding scFv, which is N-terminal to the first linker, which is N-terminal to the EGFRvIII-binding scFv, which is N-terminal to the second linker, which is N-terminal to the CD3-binding scFv. In some embodiments, the signal peptide is N-terminal to the EGFRvIII-binding scFv, which is N-terminal to the first linker, which is N-terminal to the EGFR-binding scFv, which is N-terminal to the second linker, which is N-terminal to the CD3-binding scFv.

In some embodiments, the T-cell engager (TE or BiTE) comprises at least two GPC3-binding scFv. In some embodiments, the T-cell engager (TE or BiTE) comprises two GPC3-binding scFv. In some embodiments, the signal peptide is N-terminal to the first GPC3-binding scFv, which is N-terminal to the first linker, which is N-terminal to the second GP3-binding scFv, which is N-terminal to the second linker, which is N-terminal to the CD3-binding scFv.

In some embodiments, the signal peptide is N-terminal to the first EGFR-binding nanobody, which is N-terminal to the first linker, which is N-terminal to the CD3-binding scFv, which is N-terminal to the second linker, which is N-terminal to the second EGFR-binding nanobody (FIG. 6, bottom panel).

In some embodiments, the signal peptide is N-terminal to the first EGFRvIII-binding nanobody, which is N-terminal to the first linker, which is N-terminal to the CD3-binding scFv, which is N-terminal to the second linker, which is N-terminal to the second EGFRvIII-binding nanobody (FIG. 6, bottom panel).

In some embodiments, the signal peptide is N-terminal to the first GPC3-binding nanobody, which is N-terminal to the first linker, which is N-terminal to the CD3-binding scFv, which is N-terminal to the second linker, which is N-terminal to the second GPC3-binding nanobody.

In some embodiments, the signal peptide is N-terminal to the EGFR-binding nanobody, which is N-terminal to the first linker, which is N-terminal to the CD3-binding scFv, which is N-terminal to the second linker, which is N-terminal to the EGFRvIII-binding nanobody.

In some embodiments, the signal peptide is N-terminal to the EGFRvIII-binding nanobody, which is N-terminal to the first linker, which is N-terminal to the CD3-binding scFv, which is N-terminal to the second linker, which is N-terminal to the EGFR-binding nanobody.

In some embodiments, the T-cell engager (TE or BiTE) comprises the amino acid sequence of SEQ ID NO: 26 or 27 (Table 2) or 178 or 292.

In some embodiments, the T-cell engager (TE or BiTE) comprises an amino acid sequence that is at least 60% identical to the amino acid sequence of SEQ ID NO: 26, 27, 178 or 292, or a combination thereof. For example, the sequence identity to SEQ ID NO: 26, 27, 178 or 292, or a combination thereof can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the T-cell engager (TE or BiTE) comprises an amino acid sequence that is at least 80%, 85%, 90%, 95%, 98%, or 99% identical to the amino acid sequence of SEQ ID NO: 26, 27, 178 or 292, or a combination thereof.

In some embodiments, the T-cell engager (TE or BiTE) comprises at least one amino acid substitution, relative to SEQ ID NO: 26, 27, 178 or 292, or a combination thereof.

In some embodiments, the T-cell engager (TE or BiTE) comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90, 95, 100, 110, 120, 130, 140, 150, 160, 170. 180, 190, 200 or 210 amino acid substitutions, relative to SEQ ID NO: 26, 27, 178 or 292, or a combination thereof. In some embodiments, the T-cell engager (TE or BiTE) comprises about 1-210 amino acid substitutions, relative to the amino acid sequence of SEQ ID NO: 26, 27, 178 or 292, or a combination thereof. In some embodiments, the T-cell engager (TE or BiTE) comprises about: 1-200, 2-210, 2-200, 4-200, 4-180, 6-180, 6-160, 8-160, 8-140, 10-140, 10-120, 15-120, 15-100, 20-100, 20-80, 25-80, 25-60, 30-60 or 30-40 amino acid substitutions, relative to the amino acid sequence of SEQ ID NO: 26, 27, 178 or 292, or a combination thereof. In some embodiments, the T-cell engager (TE or BiTE) comprises about 1-60 amino acid substitutions, relative to the amino acid sequence of SEQ ID NO: 26, 27, 178 or 292, or a combination thereof. In some embodiments, the T-cell engager (TE or BiTE) comprises about 1-25 amino acid substitutions, relative to the amino acid sequence of SEQ ID NO: 26, 27, 178 or 292, or a combination thereof. In some embodiments, the T-cell engager (TE or BiTE) comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 26, 27, 178 or 292, or a combination thereof. In some embodiments, the T-cell engager (TE or BiTE) comprises up to about: 160, 150, 140, 130, 120, 110, 100, 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 26, 27, 178 or 292, or a combination thereof. In some embodiments, the amino acid substitutions include at least one conservative substitution. In some embodiments, the amino acid substitutions include at least one highly conservative substitution.

In some embodiments, the signal peptide is N-terminal to the first EGFR-binding scFv, which is N-terminal to the first linker, which is N-terminal to the CD3-binding scFv, which is N-terminal to the second linker, which is N-terminal to the second EGFR-binding scFv.

In some embodiments, the signal peptide is N-terminal to the first EGFRvIII-binding scFv, which is N-terminal to the first linker, which is N-terminal to the CD3-binding scFv, which is N-terminal to the second linker, which is N-terminal to the second EGFRvIII-binding scFv.

In some embodiments, the signal peptide is N-terminal to the first GPC3-binding scFv, which is N-terminal to the first linker, which is N-terminal to the CD3-binding scFv, which is N-terminal to the second linker, which is N-terminal to the second GPC3-binding scFv.

In some embodiments, the signal peptide is N-terminal to the EGFR-binding scFv, which is N-terminal to the first linker, which is N-terminal to the CD3-binding scFv, which is N-terminal to the second linker, which is N-terminal to the EGFRvIII-binding scFv.

In some embodiments, the signal peptide is N-terminal to the EGFRvIII-binding scFv, which is N-terminal to the first linker, which is N-terminal to the CD3-binding scFv, which is N-terminal to the second linker, which is N-terminal to the EGFR-binding scFv.

T-Cell Engager (TE or BiTE)

In another aspect, the disclosure provides a T-cell engager (TE or BiTE) capable of binding to a T cell, a first TAA epitope, and a second TAA epitope, wherein the T-cell engager is produced in situ by a CAR T-cell, is secreted or released by a CAR T c-cell, or a combination thereof, through an interaction of a CAR and a first TAA. In some embodiments, the T-cell engager (TE or BiTE) is defined as any one of the T-cell engagers (TEs or BiTEs) described herein.

In some embodiments, the T-cell engager (TE or BiTE) is encoded in a polynucleotide having a sequence encoding the CAR. In some embodiments, the CAR T-cell comprises a polynucleotide comprising a sequence encoding the T-cell engager (TE or BiTE). In some embodiments, the CAR T-cell comprises a polynucleotide comprising a sequence encoding the CAR. In certain embodiments, the CAR T-cell comprises a polynucleotide comprising a sequence encoding the T-cell engager (TE or BiTE) and a sequence encoding the CAR. In certain embodiments, the CAR T-cell comprises a first polynucleotide comprising a sequence encoding the T-cell engager (TE or BiTE) and a second polynucleotide comprising a sequence encoding the CAR.

In some embodiments, the CAR is capable of binding to a first TAA. In certain embodiments, the first TAA is CEA, GPC3, MUC-1, EpCAM, HER receptors, PEM, Caludi 6, Cluadi-18.2, mesothelin, A33, G250, carbohydrate antigens Ley, Lex, Leb, PSMA, TAG-72, STEAP1, CD166, CD24, CD44, E-cadherin, SPARC, ErbB2, ErbB3, MUC1, LMP2, idiotype, HPV E6&E7, EGFR, EGFRvIII, HER-2/neu, MAGE A3, NY-ESO-1, GD2, PSMA, PCSA, PSA, MelanA/MART1, CD19, CD20, CD22, CD33, CD5, CD70, or BCMA. In particular embodiments, the first TAA is HER2, GPC3, EGFR, EGFRvIII, or GPC3.

In some embodiments, the T-cell engager (TE or BiTE) is capable of binding to CD2, CD3, VLA-1, CD8, CD4, CCR6, CXCR5, CD25, CD31, CD45RO, CD197, CD127, CD38, CD27, CD196, CD277, or CXCR3. In certain embodiments, the T-cell engager (TE or BiTE) is capable of binding to CD2, CD3, CD31, or CD277. In particular embodiments, the T-cell engager (TE or BiTE) is capable of binding to CD3.

In some embodiments, the first TAA epitope and the second TAA epitope are on a second TAA. In some embodiments, the first TAA epitope and the second TAA epitope are on two second TAAs.

In certain embodiments, the second TAA is CEA, GPC3, MUC-1, EpCAM, HER receptors, PEM, Caludi 6, Cluadi-18.2, mesothelin, A33, G250, carbohydrate antigens Ley, Lex, Leb, PSMA, TAG-72, STEAP1, CD166, CD24, CD44, E-cadherin, SPARC, ErbB2, ErbB3, MUC1, LMP2, idiotype, HPV E6&E7, EGFR, EGFRvIII, HER-2/neu, MAGE A3, NY-ESO-1, GD2, PSMA, PCSA, PSA, MelanA/MART1, CD19, CD20, CD22, CD33, CD5, CD70, or BCMA. In particular embodiments, the first TAA is HER2, GPC3, EGFR, EGFRvIII, or GPC3. In certain embodiments, the second TAA each independently is EGFR, EGFRvIII, or GPC-3.

In some embodiments, the T-cell engager (TE or BiTE) comprises a single-chain variable fragment (scFv), a nanobody, or a combination thereof.

In some embodiments, the T-cell engager (TE or BiTE) is produced in situ by a CAR T cell. In certain embodiments, the T-cell engager (TE or BiTE) is produced proximate to a CAR T cell. In certain embodiments, the T-cell engager (TE or BiTE) is produced proximate to a CAR T cell and a tumor cell. In certain embodiments, the CAR T cell secrets a T-cell engager (TE or BiTE).

In some embodiments, the CAR T cell is activated. In certain embodiments, the CAR T cell is activated by a molecule in the environment where the CAR T cell is in. In certain embodiments, the CAR T cell is activated by a molecule in the tumor microenvironment where the CAR T cell is in. In certain embodiments, the CAR T cell is activated by an antigen. In particular embodiments, the CAR T cell is activated by an TAA. In particular embodiments, the CAR T cell is activated by an interaction between a surface receptor on the CAR T cell and an TAA. For example, the surface receptor on the CAR T cell can be a CAR.

In some embodiments, the CAR T cell is activated via an immune synapse. In certain embodiments, the T-cell engager (TE or BiTE) is produced by a CAR T cell upon a T cell activation via an immune synapse through an interaction of CAR and a TAA.

C. Polynucleotides Encoding Dual-CAR and T-Cell Engager (TE or BiTE) Fusion Protein In another aspect, the disclosure provides a polynucleotide comprising a sequence that encodes a fusion protein of any one of the dual-CARs described herein and any one of the T-cell engager (TE or BiTE) described herein.

In some embodiments, the dual-CAR targets HER2 and IL13Rα2, and the T-cell engager (TE or BiTE) is capable of binding to CD3 and a TAA (e.g., a glioblastoma tumor antigen).

In some embodiments, the bi-specific CAR comprises any one of the IL13 muteins described herein, linked to any one of the HER2-binding scFvs described herein via any one of the linker sequences described herein.

In some embodiments, the bi-specific CAR further comprises any one of the CD8α signal peptides described herein, any one of the CD8α hinges described herein, any one of the CD28 transmembrane domains described herein, any one of the 4-1BB costimulatory domains described herein, any one of the CD3ζ signaling domains described herein, or a combination thereof. In some embodiments, the bi-specific CAR further comprises any one of the CD8α signal peptides described herein, any one of the CD8α hinges described herein, any one of the CD28 transmembrane domains described herein, any one of the 4-1BB costimulatory domains described herein and any of one the CD3ζ signaling domains described herein.

In some embodiments, the T-cell engager (TE or BiTE) comprises any one of the CD3-binding scFvs described herein.

In some embodiments, the TAA (e.g., glioblastoma cancer antigen) is EGFR.

In some embodiments, the T-cell engager (TE or BiTE) comprises at least one of the EGFR-binding nanobodies described herein. In some embodiments, the T-cell engager (TE or BiTE) comprises at least two of the EGFR-binding nanobodies described herein. In some embodiments, the T-cell engager (TE or BiTE) comprises any one of the anti-EGFR antibodies described herein.

In some embodiments, the TAA (e.g., glioblastoma cancer antigen) is EGFRvIII.

In some embodiments, the T-cell engager (TE or BiTE) comprises at least one of the EGFRvIII-binding nanobodies described herein. In some embodiments, the T-cell engager (TE or BiTE) comprises at least two of the EGFRvIII-binding nanobodies described herein. In some embodiments, the T-cell engager (TE or BiTE) comprises any one of the anti-EGFR antibodies described herein.

In some embodiments, the TAA is GPC3.

In some embodiments, the T-cell engager (TE or BiTE) comprises at least one of the GPC3-binding nanobodies described herein. In some embodiments, the T-cell engager (TE or BiTE) comprises at least two of the GPC3-binding nanobodies described herein. In some embodiments, the T-cell engager (TE or BiTE) comprises any one of the anti-GPC3 antibodies described herein.

In some embodiments, the T-cell engager (TE or BiTE) further comprises any one of the linkers described herein, any one of the signal peptides described herein, any one of the peptide tags described herein, or a combination thereof.

1. Self-Cleaving Peptide

In some embodiments, dual-CAR_BiTE fusion protein further comprises a self-cleaving peptide. In some embodiments, the self-cleaving peptide is a self-cleaving T2A peptide.

In some embodiments, the self-cleaving T2A Peptide comprises the amino acid sequence of SEQ ID NO: 28 (Table 3). In some embodiments, the self-cleaving T2A peptide comprises an amino acid sequence that is at least 90% (e.g., 91%, 92%, 93%, 94%, 95%, 96%, 97%, 98% or 99%) identical to the amino acid sequence of SEQ ID NO: 28. In some embodiments, the self-cleaving T2A peptide comprises at least one amino acid substitution (e.g., 1, 2 or 3 amino acid substitutions), relative to SEQ ID NO: 28. In some embodiments, the amino acid substitutions include at least one conservative substitution. In some embodiments, the amino acid substitutions include at least one highly conservative substitution.

2. Configurations a. EGFR or EGFRvIII-Binding scFv

Figure 10:
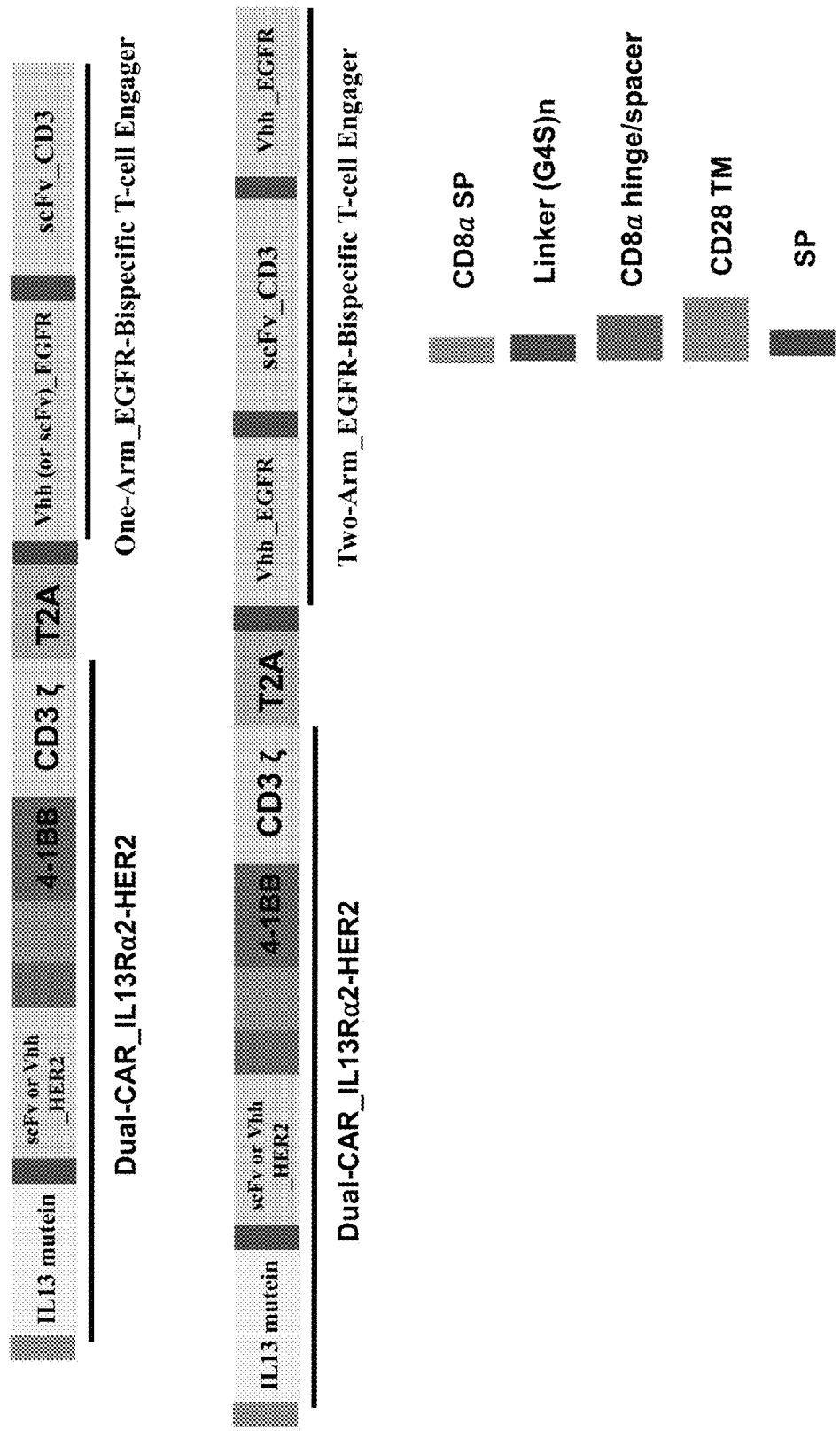
FIG. 10 is a graphic representation of non-limiting examples of Dual-CAR_BiTE structures of the disclosure.
Figure 11:
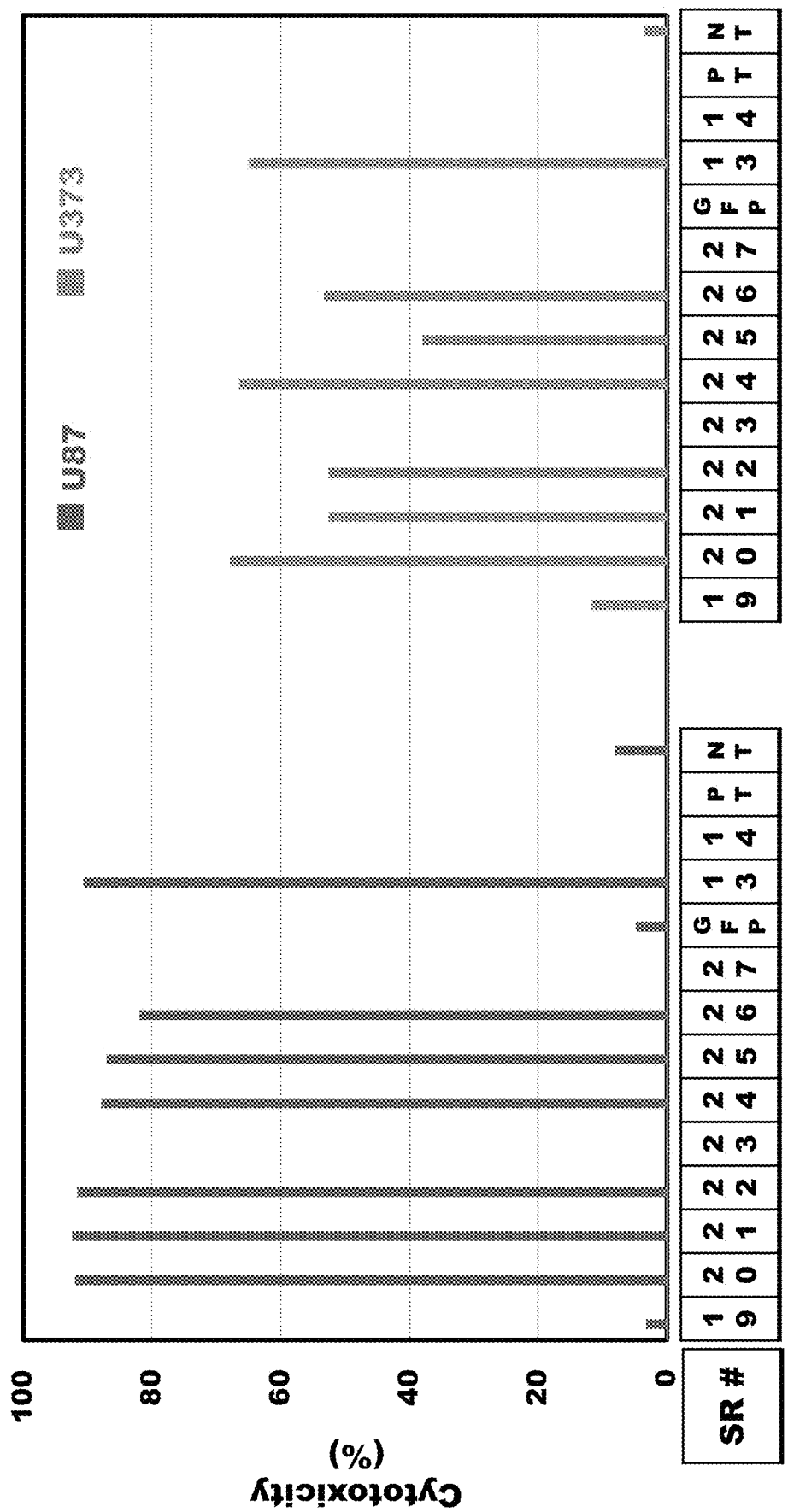
FIG. 11 shows results of luciferase-based killing assay. The data each was collected at 24 hours post BiTE treatment using the E/T ratio of 1 and is the average of the repeating assays (N=3; BiTE concentration: 5 ng/ml). The BiTEs used here were produced by constructs of Dual CAR-BiTE in 293T cells. GFP: GFP Pan T cells; PT: Pan T cells; NT: only SR13 BiTE without T cells.
Figure 12:
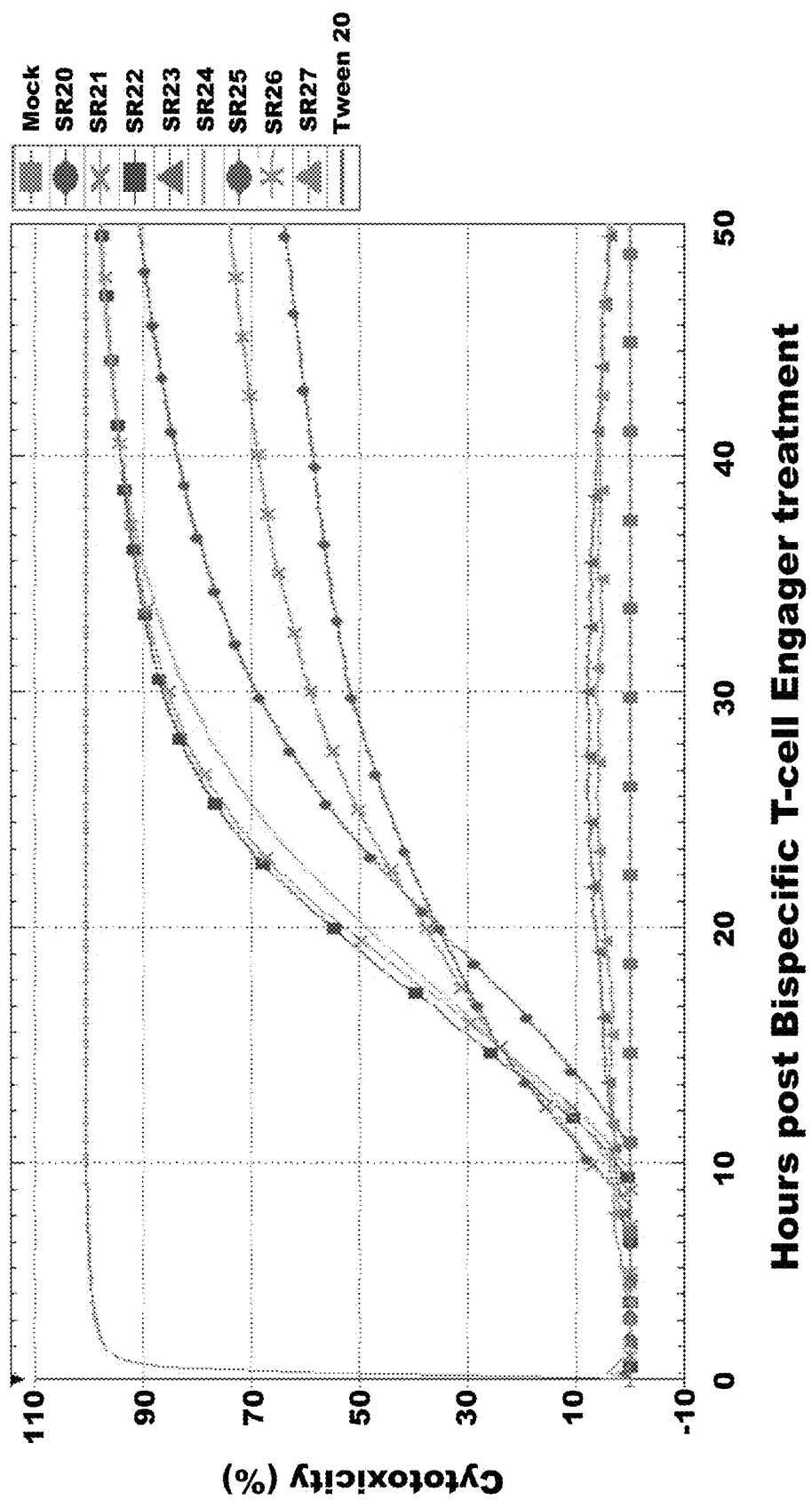
FIG. 12 shows results of RTCA-based killing assay. The target cancer cell line is GBM line U373. The data each is the average of the repeating assays (N=6; BiTE concentration: 5 ng/ml; E/T=0.5). The BiTEs used here were produced by constructs of Dual CAR-BiTE in 293T cells.
Figure 13:
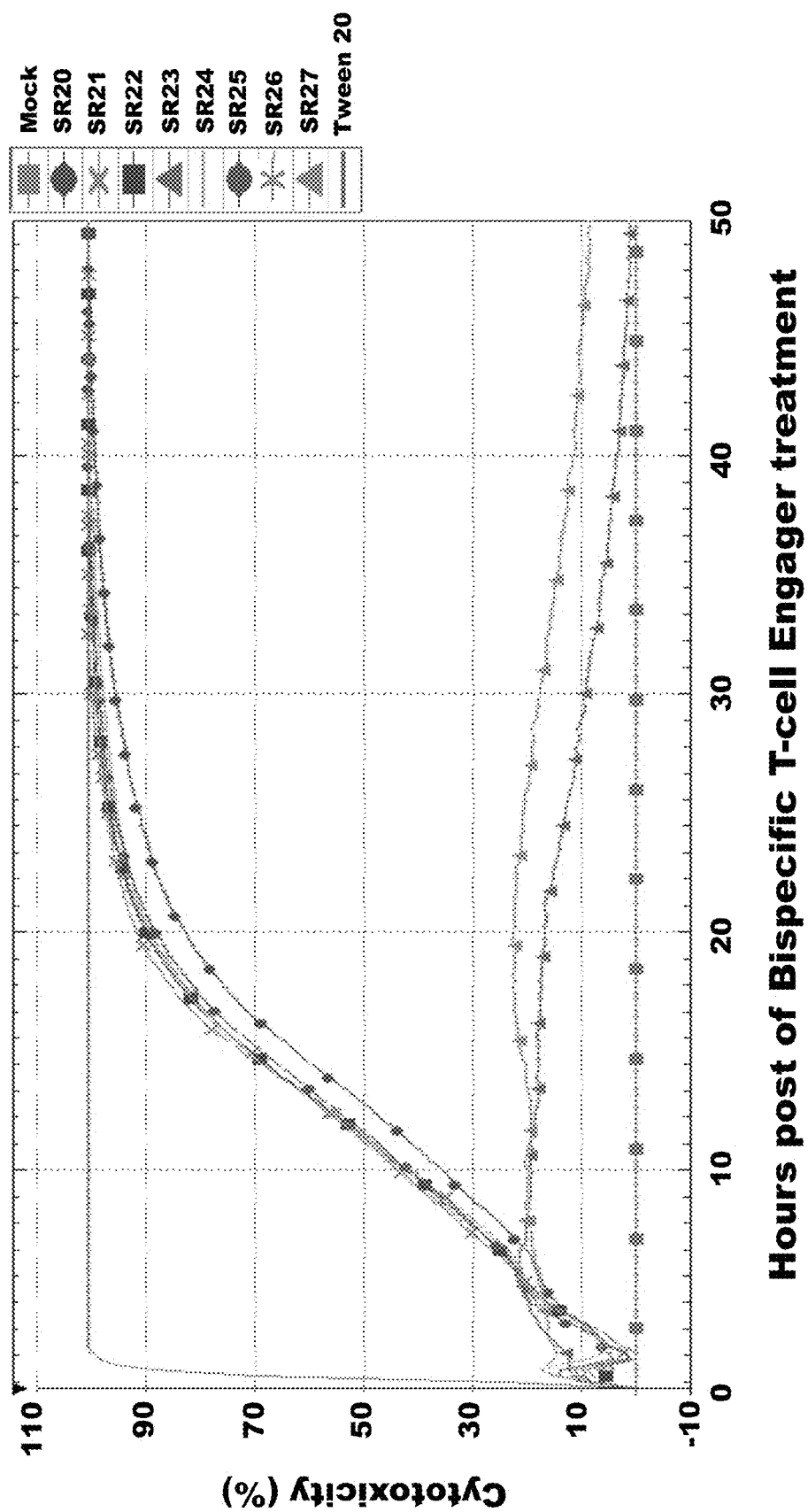
FIG. 13 shows results of RTCA-based killing assay. The target cancer cell line is GBM line T98G. The data each is the average of the repeating assays (N=6; BiTE concentration: 5 ng/ml; E/T=0.5). The BiTEs used here were produced by constructs of Dual CAR-BiTE in 293T cells.
Figure 14:
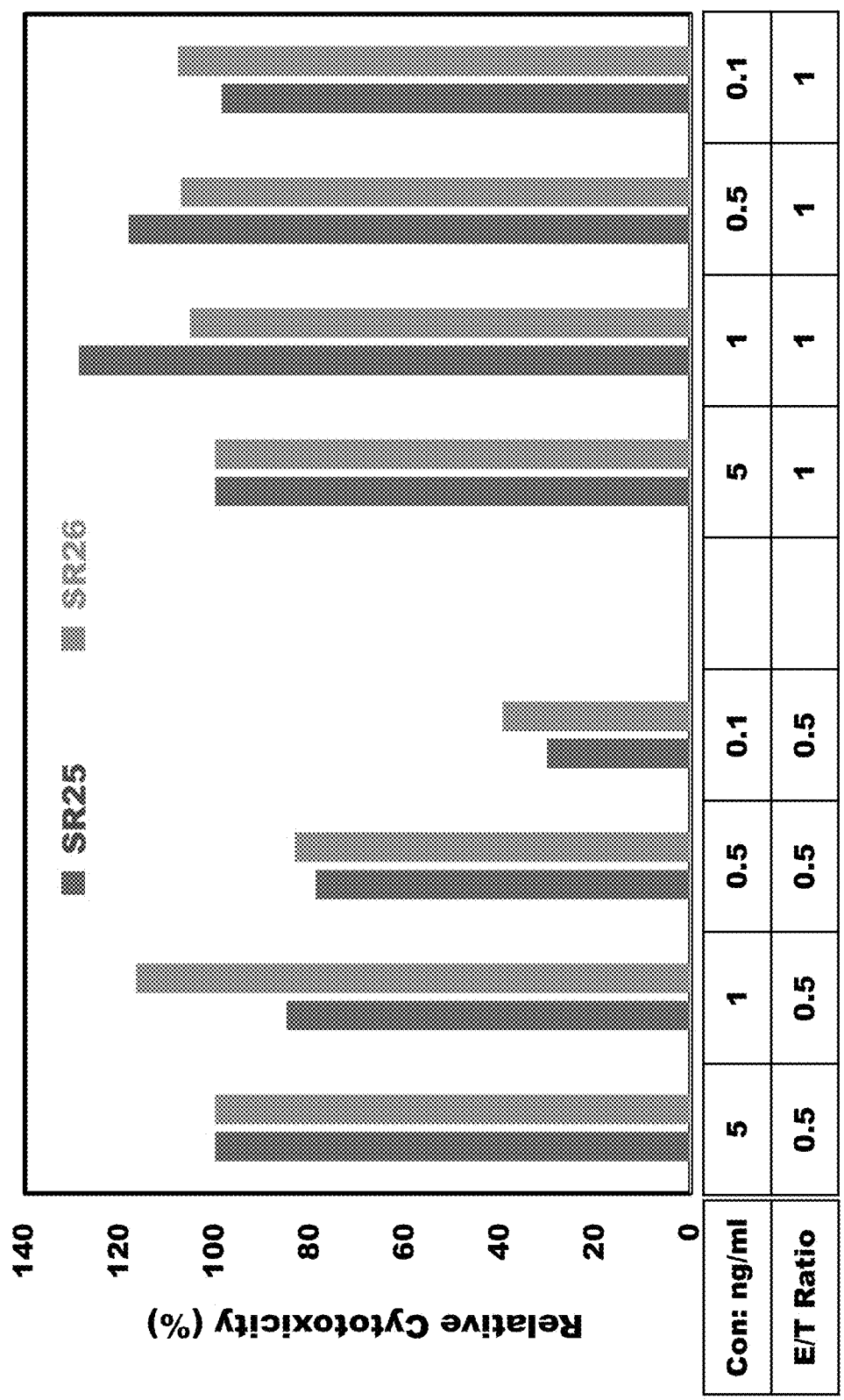
FIG. 14 shows results of luciferase-based killing assay. The data each was collected at 24 hours post treatment and is the average of the repeating assays (N=6). The BiTEs used here were produced by constructs of Dual CAR-BiTE in 293T cells.

In some embodiments, the dual-CAR_BiTE fusion protein comprises one anti-EGFR antibody or antigen-binding fragment thereof. In some embodiments, the CD8α signal peptide is N-terminal to IL13 mutein, which is N-terminal to the (GGGGS)₃ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the anti-EGFR antibody, which is N-terminal to the linker, which is N-terminal to the CD3-binding scFv (FIG. 10, top panel).

In some embodiments, the dual-CAR_BiTE fusion protein comprises one anti-EGFRvIII antibody or antigen-binding fragment thereof. In some embodiments, the CD8α signal peptide is N-terminal to IL13 mutein, which is N-terminal to the (GGGGS)₃ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the anti-EGFRvIII antibody, which is N-terminal to the linker, which is N-terminal to the CD3-binding scFv (FIG. 10, top panel).

GPC3-Binding scFv

In some embodiments, the dual-CAR_BiTE fusion protein comprises one anti-GPC3 antibody or antigen-binding fragment thereof. In some embodiments, the CD8α signal peptide is N-terminal to IL13 mutein, which is N-terminal to the (GGGGS)₃ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the anti-GPC3 antibody, which is N-terminal to the linker, which is N-terminal to the CD3-binding scFv.

In some embodiments, the anti-EGFR antibody is Cetuximab. In some embodiments, the antigen-binding fragment is the scFv of Cetuximab.

In some embodiments, the dual-CAR_BiTE fusion protein comprises the amino acid sequence of SEQ ID NO: 31 or 35 (Table 3).

In some embodiments, the dual-CAR_BiTE fusion protein comprises an amino acid sequence that is at least 60% identical to the amino acid sequence of SEQ ID NO: 31 or 35, or a combination thereof. For example, the sequence identity to SEQ ID NO: 31 or 35, or a combination thereof, can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the dual-CAR_BiTE fusion protein comprises an amino acid sequence that is at least 80%, 85%, 90%, 95%, 98%, or 99% identical to the amino acid sequence of SEQ ID NO: 31 or 35, or a combination thereof.

In some embodiments, the dual-CAR_BiTE fusion protein comprises at least one amino acid substitution, relative to SEQ ID NO: 31 or 35, or a combination thereof. In some embodiments, the dual-CAR_BiTE fusion protein comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90, 95, 100, 150, 200, 250, 300, 350 or 400 amino acid substitutions, relative to SEQ ID NO: 31 or 35, or a combination thereof. In some embodiments, the dual-CAR_BiTE fusion protein comprises about 1-400 amino acid substitutions, relative to the amino acid sequence of SEQ ID NO: 31 or 35, or a combination thereof. In some embodiments, the dual-CAR_BiTE fusion protein comprises about: 1-400, 2-350, 2-300, 4-300, 4-250, 6-250, 6-200, 8-200, 8-150, 10-150, 10-100, 15-100, 15-80, 20-80, 20-60, 25-60 or 25-40 amino acid substitutions, relative to the amino acid sequence of SEQ ID NO: 31 or 35, or a combination thereof. In some embodiments, the dual-CAR_BiTE fusion protein comprises about 1-120 amino acid substitutions, relative to the amino acid sequence of SEQ ID NO: 31 or 35, or a combination thereof. In some embodiments, the dual-CAR BiTE fusion protein comprises about: 1-110, 2-110, 2-100, 4-100, 4-90, 6-90, 6-80, 8-80, 8-70, 10-70, 10-60, 15-60, 15-50, 20-50, 20-40, 25-40 or 25-30 amino acid substitutions, relative to the amino acid sequence of SEQ ID NO: 31 or 35, or a combination thereof. In some embodiments, the dual-CAR_BiTE fusion protein comprises about 1-60 amino acid substitutions, relative to the amino acid sequence of SEQ ID NO: 31 or 35, or a combination thereof. In some embodiments, the dual-CAR_BiTE fusion protein comprises about 1-25 amino acid substitutions, relative to the amino acid sequence of SEQ ID NO: 31 or 35, or a combination thereof. In some embodiments, the dual-CAR_BiTE fusion protein comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 31 or 35, or a combination thereof. In some embodiments, the dual-CAR_BiTE fusion protein comprises up to about: 400, 350, 300, 250, 200, 150, 100, 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 31 or 35, or a combination thereof. In some embodiments, the amino acid substitutions include at least one conservative substitution. In some embodiments, the amino acid substitutions include at least one highly conservative substitution.

b. One EGFR or EGFRvIII-Binding Nanobody

In some embodiments, the dual-CAR_BiTE fusion protein comprises one EGFR-binding nanobody. In some embodiments, the CD8α signal peptide is N-terminal to IL13 mutein, which is N-terminal to the (GGGGS)$_3$ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the EGFR-binding nanobody, which is N-terminal to the linker, which is N-terminal to the CD3-binding scFv (FIG. 10, top panel).

In some embodiments, the dual-CAR_BiTE fusion protein comprises one EGFRvIII-binding nanobody. In some embodiments, the CD8α signal peptide is N-terminal to IL13 mutein, which is N-terminal to the (GGGGS)$_3$ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the EGFRvIII-binding nanobody, which is N-terminal to the linker, which is N-terminal to the CD3-binding scFv (FIG. 10, top panel).

In some embodiments, the dual-CAR_BiTE fusion protein comprises the amino acid sequence of SEQ ID NO: 32 or 36 (Table 3).

In some embodiments, the dual-CAR_BiTE fusion protein comprises an amino acid sequence that is at least 60% identical to the amino acid sequence of SEQ ID NO: 32 or 36, or a combination thereof. For example, the sequence identity to SEQ ID NO: 32 or 36, or a combination thereof, can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the dual-CAR_BiTE fusion protein comprises an amino acid sequence that is at least 80%, 85%, 90%, 95%, 98%, or 99% identical to the amino acid sequence of SEQ ID NO: 32 or 36, or a combination thereof.

In some embodiments, the dual-CAR_BiTE fusion protein comprises at least one amino acid substitution, relative to SEQ ID NO: 32 or 36, or a combination thereof. In some embodiments, the dual-CAR_BiTE fusion protein comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90, 95, 100, 150, 200, 250, 300, 350 or 400 amino acid substitutions, relative to SEQ ID NO: 32 or 36, or a combination thereof. In some embodiments, the dual-CAR_BiTE fusion protein comprises about 1-400 amino acid substitutions, relative to the amino acid sequence of SEQ ID NO: 32 or 36, or a combination thereof. In some embodiments, the dual-CAR_BiTE fusion protein comprises about: 1-400, 2-350, 2-300, 4-300, 4-250, 6-250, 6-200, 8-200, 8-150, 10-150, 10-100, 15-100, 15-80, 20-80, 20-60, 25-60 or 25-40 amino acid substitutions, relative to the amino acid sequence of SEQ ID NO: 32 or 36, or a combination thereof. In some embodiments, the dual-CAR_BiTE fusion protein comprises about 1-120 amino acid substitutions, relative to the amino acid sequence of SEQ ID NO: 32 or 36, or a combination thereof. In some embodiments, the dual-CAR_BiTE fusion protein comprises about: 1-110, 2-110, 2-100, 4-100, 4-90, 6-90, 6-80, 8-80, 8-70, 10-70, 10-60, 15-60, 15-50, 20-50, 20-40, 25-40 or 25-30 amino acid substitutions, relative to the amino acid sequence of SEQ ID NO: 32 or 36, or a combination thereof. In some embodiments, the dual-CAR_BiTE fusion protein comprises about 1-60 amino acid substitutions, relative to the amino acid sequence of SEQ ID NO: 32 or 36, or a combination thereof. In some embodiments, the dual-CAR_BiTE fusion protein comprises about 1-25 amino acid substitutions, relative to the amino acid sequence of SEQ ID NO: 32 or 36, or a combination thereof. In some embodiments, the dual-CAR_BiTE fusion protein comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 32 or 36, or a combination thereof. In some embodiments, the dual-CAR_BiTE fusion protein comprises up to about: 400, 350, 300, 250, 200, 150, 100, 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 32 or 36, or a combination thereof. In some embodiments, the amino acid substitutions include at least one conservative substitution. In some embodiments, the amino acid substitutions include at least one highly conservative substitution.

c. Two EGFR or EGFRvIII-Binding Nanobodies

In some embodiments, the dual-CAR_BiTE fusion protein comprises at least two EGFR-binding nanobodies. In some embodiments, the dual-CAR_BiTE fusion protein comprises two EGFR-binding nanobodies. In some embodiments, the CD8α signal peptide is N-terminal to IL13 mutein, which is N-terminal to the (GGGGS)$_3$ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the first EGFR-binding nanobody, which is N-terminal to the linker, which is N-terminal to the CD3-binding scFv, which is N-terminal to the linker, which is to the second EGFR-binding nanobody (FIG. 10, bottom panel).

In some embodiments, the dual-CAR_BiTE fusion protein comprises at least two EGFRvIII-binding nanobodies. In some embodiments, the dual-CAR_BiTE fusion protein comprises two EGFRvIII-binding nanobodies. In some embodiments, the CD8α signal peptide is N-terminal to IL13 mutein, which is N-terminal to the (GGGGS)$_3$ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the first EGFRvIII-binding nanobody, which is N-terminal to the linker, which is N-terminal to the CD3-binding scFv, which is N-terminal to the linker, which is to the second EGFRvIII-binding nanobody (FIG. 10, bottom panel).

In some embodiments, the dual-CAR_BiTE fusion protein comprises at least one EGFR-binding nanobody and at least one EGFRvIII-binding nanobody. In some embodiments, the dual-CAR_BiTE fusion protein comprises one EGFR-binding nanobody and one EGFRvIII-binding nanobody.

In some embodiments, the CD8α signal peptide is N-terminal to IL13 mutein, which is N-terminal to the (GGGGS)$_3$ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the EGFR-binding nanobody, which is N-terminal to the linker, which is N-terminal to the CD3-binding scFv, which is N-terminal to the linker, which is to the EGFRvIII-binding nanobody.

In some embodiments, the CD8α signal peptide is N-terminal to IL13 mutein, which is N-terminal to the (GGGGS)$_3$ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the EGFRvIII-binding nanobody, which is N-terminal to the linker, which is N-terminal to the CD3-binding scFv, which is N-terminal to the linker, which is to the EGFR-binding nanobody.

Two GPC3-Binding Nanobodies

In some embodiments, the dual-CAR_BiTE fusion protein comprises at least two GPC3-binding nanobodies. In some embodiments, the dual-CAR_BiTE fusion protein comprises two GPC3-binding nanobodies. In some embodiments, the CD8α signal peptide is N-terminal to IL13 mutein, which is N-terminal to the (GGGGS)$_3$ linker, which is N-terminal to the HER2-binding scFv, which is N-terminal to the CD8α hinge, which is N-terminal to the CD28 transmembrane domain, which is N-terminal to the 4-1BB costimulatory domain, which is N-terminal to the CD3ζ signaling domain, which is N-terminal to the self-cleaving T2A peptide, which is N-terminal to the signal peptide, which is N-terminal to the first GPC3-binding nanobody, which is N-terminal to the linker, which is N-terminal to the CD3-binding scFv, which is N-terminal to the linker, which is to the second GPC3-binding nanobody.

In some embodiments, the dual-CAR_BiTE fusion protein comprises the amino acid sequence of SEQ ID NO: 33 or 37 (Table 3).

In some embodiments, the dual-CAR_BiTE fusion protein comprises an amino acid sequence that is at least 60% identical to the amino acid sequence of SEQ ID NO: 33 or 37, or a combination thereof. For example, the sequence identity to SEQ ID NO: 33 or 37, or a combination thereof, can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In some embodiments, the dual-CAR_BiTE fusion protein comprises an amino acid sequence that is at least 80%, 85%, 90%, 95%, 98%, or 99% identical to the amino acid sequence of SEQ ID NO: 33 or 37, or a combination thereof.

In some embodiments, the dual-CAR_BiTE fusion protein comprises at least one amino acid substitution, relative to SEQ ID NO: 33 or 37, or a combination thereof. In some embodiments, the dual-CAR_BiTE fusion protein comprises at least: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 50, 55, 60, 65, 70, 75, 80, 85, 90, 95, 100, 150, 200, 250, 300, 350, 400 or 450 amino acid substitutions, relative to SEQ ID NO: 33 or 37, or a combination thereof. In some embodiments, the dual-CAR_BiTE fusion protein comprises about 1-450 amino acid substitutions, relative to the amino acid sequence of SEQ ID NO: 33 or 37, or a combination thereof. In some embodiments, the dual-CAR_BiTE fusion protein comprises about: 1-400, 2-450, 2-400, 4-400, 4-350, 6-350, 6-300, 8-300, 8-250, 10-250, 10-200, 15-200, 15-150, 20-150, 20-100, 25-80, 25-60, 30-60 or 30-40 amino acid substitutions, relative to the amino acid sequence of SEQ ID NO: 33 or 37, or a combination thereof. In some embodiments, the dual-CAR_BiTE fusion protein comprises about 1-120 amino acid substitutions, relative to the amino acid sequence of SEQ ID NO: 33 or 37, or a combination thereof. In some embodiments, the dual-CAR_BiTE fusion protein comprises about: 1-110, 2-110, 2-100, 4-100, 4-90, 6-90, 6-80, 8-80, 8-70, 10-70, 10-60, 15-60, 15-50, 20-50, 20-40, 25-40 or 25-30 amino acid substitutions, relative to the amino acid sequence of SEQ ID NO: 33 or 37, or a combination thereof. In some embodiments, the dual-CAR_BiTE fusion protein comprises about 1-60 amino acid substitutions, relative to the amino acid sequence of SEQ ID NO: 33 or 37, or a combination thereof. In some embodiments, the dual-CAR_BiTE fusion protein comprises about 1-25 amino acid substitutions, relative to the amino acid sequence of SEQ ID NO: 33 or 37, or a combination thereof. In some embodiments, the dual-CAR_BiTE fusion protein comprises about: 1-24, 2-25, 2-24, 3-24, 3-22, 4-22, 4-20, 5-20, 5-18, 6-18, 6-16, 7-16, 7-14, 8-14, 8-12 or 10-12 amino acid substitutions, relative to the amino acid sequence of SEQ ID NO: 33 or 37, or a combination thereof. In some embodiments, the dual-CAR_BiTE fusion protein comprises up to about: 400, 350, 300, 250, 200, 150, 100, 95, 90, 85, 80, 75, 70, 65, 60, 55, 50, 45, 40, 35, 30, 25, 20, 15, 10, 6 or 5 amino acid substitutions, relative to the amino acid sequence of SEQ ID NO: 33 or 37, or a combination thereof. In some embodiments, the amino acid substitutions include at least one conservative substitution. In some embodiments, the amino acid substitutions include at least one highly conservative substitution.

In some embodiments, the polynucleotide comprises a nucleotide sequence that is codon-optimized for a mammalian (e.g., human) cell.

In another aspect, the disclosure provides a polynucleotide comprising a sequence encoding an amino acid sequence, wherein the amino acid sequence is at least 60% identical to at least one amino acid sequence set forth in SEQ ID NOs: 2-4, SEQ ID NOs: 11-13 and 52, SEQ ID NOs: 15-17, SEQ ID NOs: 21-23, SEQ ID NOs: 49 and 50, SEQ ID NOs: 53-70, SEQ ID NOs: 72-82, SEQ ID NOs:83-104, SEQ ID NOs: 120-137, SEQ ID NOs: 139-149, SEQ ID NOs: 150-171, SEQ ID NOs: 188-191, SEQ ID NOs: 204 and 206-214, SEQ ID NOs: 215-221, or SEQ ID NOs: 242-291, or a combination thereof. For example, the sequence identity can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In certain embodiments, the amino acid sequence is at least 90% (e.g., 91%, 92%, 93%, 94%, 95%, 96%, 97%, 98% or 99%) identical to at least one amino acid sequence set forth in SEQ ID NOs: 2-4, SEQ ID NOs: 11-13 and 52, SEQ ID NOs: 15-17, SEQ ID NOs: 21-23 and 109-111, SEQ ID NOs: 49 and 50, SEQ ID NOs: 53-70, SEQ ID NOs: 72-82, SEQ ID NOs:83-104, SEQ ID NOs: 120-137, SEQ ID NOs: 139-149, SEQ ID NOs: 150-171, SEQ ID NOs: 188-191, SEQ ID NOs: 204 and 206-214, SEQ ID NOs: 215-221, or SEQ ID NOs: 242-291, or a combination thereof. In particular embodiments, the amino acid sequence is identical to one amino acid sequence set forth in SEQ ID NOs: 2-4, 11-13, 15-17, 21-23, 49, 50, 52-70, 72-104, 109-111, 120-137, 139-171, 188-191, 204, 206-221, and 242-291.

Vectors

In another aspect, the disclosure provides a vector comprising any one or more of the polynucleotides described herein.

In some embodiments, the vector is a non-viral vector. Non-limiting examples of non-viral vectors include plasmids, bacterial artificial chromosomes (BACs), cosmids, linear artificial chromosomes.

In other embodiments, the vector is a viral vector. Non-limiting examples of viral vectors include adeno-associated virus (AAV) vectors, adenovirus vectors, anellovirus vectors, coronavirus vectors, herpes virus vectors, lentivirus vectors, polyomavirus vectors, rabies virus vectors, recombinant simian virus 40 vectors, reovirus vectors, retrovirus vectors, rhinovirus vectors, sindbis virus vectors, vaccinia virus vectors, vesicular stomatitis virus vectors, semliki forest virus vectors and yellow fever virus vectors. In certain embodiments, the viral vector is a moloney murine sarcoma virus (MoMSV), Harvey murine sarcoma virus (HaMuSV), murine mammary tumor virus (MuMTV), gibbon ape leukemia virus (GaLV), feline leukemia virus (FLV), spumavirus, Friend murine leukemia virus, Murine Stem Cell Virus (MSCV) and Rous Sarcoma Virus (RSV)) and lentivirus. Non-limiting examples of lentiviruses include human immunodeficiency virus (e.g., HIV type 1 and HIV type 2), visna-maedi virus (VMV), caprine arthritis-encephalitis virus (CAEV), equine infectious anemia virus (EIAV), feline immunodeficiency virus (FIV), bovine immune deficiency virus (BIV), or simian immunodeficiency virus (SIV) vector.

In certain embodiments, the vector (e.g., a viral vector) is a gene therapy vector.

In some embodiments, the vector is an expression vector.

In some embodiments, the vector (e.g., expression vector) further comprises an expression control polynucleotide sequence operably linked to the polynucleotide, a polynucleotide sequence encoding a selectable marker, or both. In some embodiments, the expression control polynucleotide sequence comprises a promoter sequence, an enhancer sequence, or both. In some embodiments, the expression control polynucleotide sequence comprises an inducible promoter sequence.

In some embodiments, the expression control polynucleotide sequence comprises an EF1α Core Promoter sequence, a MNDU3 Promoter sequence, or a combination thereof. In some embodiments, the expression control polynucleotide sequence comprises an EF1α Core Promoter sequence. In some embodiments, the expression control polynucleotide sequence comprises a MNDU3 Promoter sequence.

```
EF1α Core Promoter sequence
                                  (SEQ ID NO: 39)
GGGCAGAGCGCACATCGCCCACAGTCCCCGAGAAGTTGGGGGGAGG

GGTCGGCAATTGAACCGGTGCCTAGAGAAGGTGGCGCGGGGTAAAC

TGGGAAAGTGATGTCGTGTACTGGCTCCGCCTTTTTCCCGAGGGTG

GGGGAGAACCGTATATAAGTGCAGTAGTCGCCGTGAACGTTCTTTT

TCGCAACGGGTTTGCCGCCAGAACACAG

MNDU3 Promoter sequence
                                  (SEQ ID NO: 40)
TCGATTAGTCCAATTTGTTAAAGACAGGATATCAGTGGTCCAGGCT

CTAGTTTTGACTCAACAATATCACCAGCTGAAGCCTATAGAGTACG

AGCCATAGATAGAATAAAAGATTTTATTTAGTCTCCAGAAAAAGGG

GGGAATGAAAGACCCCACCTGTAGGTTTGGCAAGCTAGGATCAAGG

TTAGGAACAGAGAGACAGCAGAATATGGGCCAAACAGGATATCTGT

GGTAAGCAGTTCCTGCCCCGGCTCAGGGCCAAGAACAGTTGGAACA

GCAGAATATGGGCCAAACAGGATATCTGTGGTAAGCAGTTCCTGCC

CCGGCTCAGGGCCAAGAACAGATGGTCCCCAGATGCGGTCCCGCCC

TCAGCAGTTTCTAGAGAACCATCAGATGTTTCCAGGGTGCCCCAAG

GACCTGAAATGACCCTGTGCCTTATTTGAACTAACCAATCAGTTCG

CTTCTCGCTTCTGTTCGCGCGCTTCTGCTCCCCGAGCTCAATAAAA

GAGCCCACAACCCCTCACTCGGCGCGATC
```

Fusion Proteins

In another aspect, the disclosure provides a fusion protein encoded by any one of the polynucleotides or vectors (e.g., expression vectors) described herein.

In another aspect, the disclosure provides a fusion protein, wherein the fusion protein comprises a bi-specific CAR that is capable of binding to two different antigens expressed on the surface of a cancer cell and a T-cell engager (TE or BiTE) that is capable of binding to T-cell (e.g., CD3) and a TAA (e.g., a tumor antigen such as a glioblastoma tumor antigen).

Fusion proteins of the disclosure can be produced recombinantly or synthetically, using routine methods and reagents that are well known in the art. For example, a fusion protein of the disclosure can be produced recombinantly in a suitable host cell (e.g., bacteria) according to methods known in the art. See, e.g., *Current Protocols in Molecular Biology*, Second Edition, Ausubel et al. eds., John Wiley & Sons, 1992; and *Molecular Cloning: a Laboratory Manual*, 2nd edition, Sambrook et al., 1989, Cold Spring Harbor Laboratory Press. For example, a nucleic acid molecule comprising a nucleotide sequence encoding a fusion protein described herein can be introduced and expressed in suitable host cell (e.g., *E. coli*), and the expressed fusion protein can be isolated/purified from the host cell (e.g., in inclusion bodies) using routine methods and readily available reagents. For example, DNA fragments coding for different protein sequences (e.g., a light-responsive domain, a heterologous peptide component) can be ligated together in-frame in accordance with conventional techniques. In another embodiment, the fusion gene can be synthesized by conventional techniques including automated DNA synthesizers. Alternatively, PCR amplification of nucleic acid fragments can be carried out using anchor primers that give rise to complementary overhangs between two consecutive nucleic acid fragments that can subsequently be annealed and re-amplified to generate a chimeric nucleic acid sequence (see Ausubel et al., Current Protocols in Molecular Biology, 1992).

In some embodiments, the fusion protein further comprises a self-cleaving peptide. In certain embodiments, the self-cleaving peptide is T2A Peptide (SEQ ID NO: 28).

Host Cells

In another aspect, the disclosure provides a host cell comprising any one or more of the polynucleotides or expression vectors described herein.

In some embodiments, the host cell is useful for receiving, maintaining, reproducing and/or amplifying a vector.

Non-limiting examples of expression host cells include mammalian cells such as immune cells (e.g., T lymphocytes, B lymphocytes, NK cells), hybridoma cells, Chinese hamster ovary (CHO) cells, COS cells, human embryonic kidney (HEK), yeast cells such as Pichia pastoris cells, or bacterial cells such as DH5a, etc.

T Lymphocytes

In another aspect, the disclosure provides a T lymphocyte, comprising any one or more of the polynucleotides, expression vectors, or fusion proteins described herein.

In another aspect, the disclosure provides a T lymphocyte comprising:
 a first polynucleotide comprising a sequence encoding a CAR that is capable of binding to one or more first TAAs, and a second polynucleotide comprising a sequence encoding a T-cell engager (TE or BiTE) that is capable of binding to T-cell and a second TAA; or
 a third polynucleotide comprising a sequence encoding a fusion protein of a CAR that is capable of binding to one or more first TAA, and a T-cell engager (TE or BiTE) that is capable of binding to T-cell and a second TAA.

In another aspect, the disclosure provides a T lymphocyte comprising a first polynucleotide comprising a sequence encoding a T-cell engager (TE or BiTE) that is capable of binding to T-cell and a second TAA epitope. In some embodiments, the T lymphocyte comprises a second polynucleotide comprising a sequence encoding a CAR that is capable of binding to one or more first TAA. In some embodiments, each of the first and second polynucleotides is independently provided herein. In some embodiments, the first and second polynucleotides are connected. In some embodiments, the first and second polynucleotides are separated.

In some embodiments, the T-cell engager is capable of binding to CD2, CD3, VLA-1, CD8, CD4, CCR6, CXCR5, CD25, CD31, CD45RO, CD197, CD127, CD38, CD27, CD196, CD277, or CXCR3. In certain embodiments, the T-cell engager is capable of binding to CD2, CD3, CD31, or CD277. In particular embodiments, the T-cell engager is capable of binding to CD3.

In some embodiments, the one or more first TAAs and the second TAA each independently is expressed on a hematologic cancer (e.g., leukemia, lymphoma, myeloma) cell. Hematologic cancers that can be treated according to the methods described herein include leukemias (e.g., acute leukemias, chronic leukemias), lymphomas (e.g., B-cell lymphoma, T-cell lymphoma) and multiple myeloma. Accordingly, in some embodiments, the one or more first TAAs, the second TAA, or both are expressed on a hematologic cancer cell selected from leukemia (e.g., acute leukemias, chronic leukemias), lymphoma (e.g., B-cell lymphoma, T-cell lymphoma) and multiple myeloma cells.

In some embodiments, the one or more first TAAs and the second TAA each independently is expressed on a solid tumor cell (e.g., a tumor of the breast, lung, prostate, colon, bladder, ovary, kidney, stomach, colon, rectum, testes, head and/or neck, pancreas, brain, skin). Accordingly, in some embodiments, the one or more first TAAs and the second TAA each independently is expressed on a solid tumor cell selected from breast, lung, prostate, colon, bladder, ovarian, renal, gastric, rectal, colorectal, testicular, head and neck, pancreatic, brain and skin cancer cells.

In some embodiments, the one or more first TAAs are each independently selected from colon cancer antigen 19.9; a gastric cancer mucin; antigen 4.2; glycoprotein A33 (gpA33); ADAM-9; gastric cancer antigen AH6; ALCAM; malignant human lymphocyte antigen APO-1; cancer antigen B1; B7 H3; beta-catenin; blood group ALeb/Ley; Burkitt's lymphoma antigen-38.13, colonic adenocarcinoma antigen C14; ovarian carcinoma antigen CA125; Carboxypeptidase M; CD5; CD19; CD20; CD22; CD23; CD25; CD27; CD30; CD33; CD36; CD45; CD46; CD52; CD79a/CD79b; CD103; CD317; CDK4; carcinoembryonic antigen (CEA); CEACAM5; CEACAM6; C017-iA; CO-43 (blood group Leb); CO-514 (blood group Lea); CTA-1; CTLA4; Cytokeratin 8; antigen D1.1; antigen D 156-22; DR5; Ei series (blood group B); EGFR (Epidermal Growth Factor Receptor); Ephrin receptor A2 (EphA2); ErbB1; ErbB3; ErbB4; GAGE-1; GAGE-2; GD2/GD3/GM2; lung adenocarcinoma antigen F3; antigen FC10.2; G49, ganglioside GD2; ganglioside GD3; ganglioside GM2; ganglioside GM3; GD2; GD3; GICA 19-9; GM2; gpOO; glypican-3 (GPC3); human leukemia T cell antigen Gp37; melanoma antigen gp75; gpA33; HER2 antigen (e.g., pi85 HER2); human milk fat globule antigen (HMFG); human papillomavirus E6/human papillomavirus-E7; high molecular weight melanoma antigen (IMW MAA); I antigen (differentiation antigen) I(Ma); Integrin Alpha-V-Beta-6 IntegrinP6 (ITGB6); Interleukin-13; Receptor a2 (IL13Rα2); JAM-3; KID3; KID31; KS 1/4 pan carcinoma antigen; human lung carcinoma antigens L6 and L20; LEA; LUCA-2; Mi:22:25:8; M18; M39; MAGE-1; MAGE-3; MART; MUC-1; MUM-1; Myl; N acetylglucosaminyltransferase; neoglycoprotein; NS-10; OFA-1; OFA-2; Oncostatin M; p15; melanoma-associated antigen p97; polymorphic epithelial mucin (PEM); polymorphic epithelial mucin antigen (PEMA); PIPA; prostate-specific antigen (PSA); prostate-specific membrane antigen (PSMA); prostatic acid phosphate; R2 4; RORi; sphingolipids; SSEA-1; SSEA-3; SSEA-4; sTn; T cell receptor derived peptide; T 5A7; TAG-72; TL5 (blood group A); TNF-α receptor; TNF-β receptor; TNF-γ receptor; TRA-1-85 (blood group H); Transferrin Receptor; tumor-specific transplantation antigen (TSTA), oncofetal antigen-alpha-fetoprotein (AFP); VEGF; VEGFR, VEP8; VEP9; VIMN-D5; and Y hapten, Ley.

In some embodiments, the one or more first TAAs are each independently selected from interleukin-13 receptor subunit alpha-2 (IL13Rα2), human epidermal growth factor receptor 2 (HER2), epidermal growth factor receptor (EGFR), EGFR variant III (EGFRvIII), glypican-3 (GPC3) and combinations thereof.

In some embodiments, the second TAA is IL13Rα2, HER2, EGFR, EGFRvIII, or GPC3.

In some embodiments, the disclosure provides a T lymphocyte comprising:
- a polynucleotide comprising a sequence encoding a bi-specific CAR that is capable of binding to HER2 and IL13Rα2, and a second polynucleotide comprising a sequence encoding a T-cell engager (TE or BiTE) that is capable of binding to CD3 and a TAA (e.g., a glioblastoma tumor antigen); or
- a third polynucleotide comprising a sequence encoding a fusion protein of a bi-specific CAR that is capable of binding to HER2 and IL13Rα2, and a T-cell engager (TE or BiTE) that is capable of binding to CD3 and a TAA (e.g., a glioblastoma tumor antigen).

In some embodiments, the T lymphocyte comprises the polynucleotide comprising a sequence encoding a bi-specific CAR that is capable of binding to HER2 and IL13Rα2, and the second polynucleotide comprising a sequence encoding a T-cell engager (TE or BiTE) that is capable of binding to CD3 and a TAA (e.g., a glioblastoma tumor antigen). In some embodiments, the polynucleotide is any one of the polynucleotides encoding a bi-specific CAR that targets HER2 and IL13Rα2 described herein. In some embodiments, the second polynucleotide is any one of the polynucleotides encoding a T-cell engager (TE or BiTE) that is capable of binding to CD3 and a TAA (e.g., a glioblastoma tumor antigen) described herein.

In some embodiments, the T lymphocyte comprises the third polynucleotide comprising a sequence encoding a fusion protein of a bi-specific CAR that is capable of binding to HER2 and IL13Rα2, and a T-cell engager (TE or BiTE) that is capable of binding to CD3 and a TAA (e.g., a glioblastoma tumor antigen). In some embodiments, the third polynucleotide is any one of the polynucleotides encoding a dual-CAR and T-cell engager (TE or BiTE) fusion protein described herein.

In some embodiments, the T lymphocyte expresses (e.g., secrets) the bi-specific CAR that is capable of binding to HER2 and IL13Rα2.

In some embodiments, the disclosure provides a T lymphocyte comprising:
- a polynucleotide comprising a sequence encoding a bi-specific CAR that is capable of binding to HER2, and a second polynucleotide comprising a sequence encoding a T-cell engager (TE or BiTE) that is capable of binding to CD3 and a TAA; or
- a third polynucleotide comprising a sequence encoding a fusion protein of a bi-specific CAR that is capable of binding to HER2, and a T-cell engager (TE or BiTE) that is capable of binding to CD3 and a TAA.

In some embodiments, the T lymphocyte comprises the polynucleotide comprising a sequence encoding a bi-specific CAR that is capable of binding to HER2, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets HER2 described herein. In some embodiments, the second polynucleotide is any one of the polynucleotides encoding a T-cell engager (TE or BiTE) that is capable of binding to CD3 and a TAA described herein.

In some embodiments, the T lymphocyte comprises a third polynucleotide comprising a sequence encoding a fusion protein of a bi-specific CAR that is capable of binding to HER2, and a T-cell engager (TE or BiTE) that is capable of binding to CD3 and a TAA. In some embodiments, the third polynucleotide is any one of the polynucleotides encoding a dual-CAR and T-cell engager (TE or BiTE) fusion protein described herein.

In some embodiments, the T lymphocyte expresses (e.g., secrets) the bi-specific CAR that is capable of binding to HER2.

In some embodiments, the bi-specific CAR is capable of binding to two epitopes of one HER2. In some embodiments, the bi-specific CAR is capable of binding to two HER2.

In some embodiments, the disclosure provides a T lymphocyte comprising:
- a polynucleotide comprising a sequence encoding a bi-specific CAR that is capable of binding to EGFR or EGFRvIII, and a second polynucleotide comprising a sequence encoding a T-cell engager (TE or BiTE) that is capable of binding to CD3 and a TAA; or
- a third polynucleotide comprising a sequence encoding a fusion protein of a bi-specific CAR that is capable of binding to EGFR or EGFRvIII, and a T-cell engager (TE or BiTE) that is capable of binding to CD3 and a TAA.

In some embodiments, the T lymphocyte comprises the polynucleotide comprising a sequence encoding a bi-specific CAR that is capable of binding to EGFR or EGFRvIII, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets EGFR or EGFRvIII described herein. In some embodiments, the second polynucleotide is any one of the polynucleotides encoding a T-cell engager (TE or BiTE) that is capable of binding to CD3 and a TAA described herein.

In some embodiments, the T lymphocyte comprises a third polynucleotide comprising a sequence encoding a fusion protein of a bi-specific CAR that is capable of binding to EGFR or EGFRvIII, and a T-cell engager (TE or BiTE) that is capable of binding to CD3 and a TAA. In some embodiments, the third polynucleotide is any one of the polynucleotides encoding a dual-CAR and T-cell engager (TE or BiTE) fusion protein described herein.

In some embodiments, the T lymphocyte expresses (e.g., secrets) the bi-specific CAR that is capable of binding to EGFR or EGFRvIII.

In some embodiments, the bi-specific CAR is capable of binding to two epitopes of one EGFR or EGFRvIII. In some embodiments, the bi-specific CAR is capable of binding to two EGFRs or EGFRvIIIs.

In some embodiments, the disclosure provides a T lymphocyte comprising:
- a polynucleotide comprising a sequence encoding a bi-specific CAR that is capable of binding to GPC3, and a second polynucleotide comprising a sequence encoding a T-cell engager (TE or BiTE) that is capable of binding to CD3 and a TAA; or
- a third polynucleotide comprising a sequence encoding a fusion protein of a bi-specific CAR that is capable of binding to GPC3, and a T-cell engager (TE or BiTE) that is capable of binding to CD3 and a TAA.

In some embodiments, the T lymphocyte comprises the polynucleotide comprising a sequence encoding a bi-specific CAR that is capable of binding to GPC3, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets GPC3 described herein. In some embodiments, the second polynucleotide is any one of the polynucleotides encoding a T-cell engager (TE or BiTE) that is capable of binding to CD3 and a TAA described herein.

In some embodiments, the T lymphocyte comprises a third polynucleotide comprising a sequence encoding a fusion protein of a bi-specific CAR that is capable of binding to GPC3, and a T-cell engager (TE or BiTE) that is capable of binding to CD3 and a TAA. In some embodiments, the third polynucleotide is any one of the polynucleotides encoding a dual-CAR and T-cell engager (TE or BiTE) fusion protein described herein.

In some embodiments, the T lymphocyte expresses (e.g., secrets) the bi-specific CAR that is capable of binding to GPC3.

In some embodiments, the bi-specific CAR is capable of binding to two epitopes of one GPC3. In some embodiments, the bi-specific CAR is capable of binding to two GPC3.

The T-cell of the disclosure can be any T-cell, such as a cultured T-cell, e.g., a primary T-cell, or a T-cell from a cultured T-cell line, or a T-cell obtained from a mammal. If obtained from a mammal, the T-cell can be obtained from numerous sources, including but not limited to blood, bone marrow, lymph node, the thymus, or other tissues or fluids. T-cells can also be enriched for or purified. The T-cell preferably is a human T-cell (e.g., isolated from a human). The T-cell can be of any developmental stage, including but not limited to, a CD4$^+$/CD8$^+$ double positive T-cell, a CD4$^+$ helper T-cell, e.g., Th, and Th$_2$ cells, a CD8$^+$ T-cell (e.g., a cytotoxic T-cell), a tumor infiltrating cell, a memory T-cell, a naive T-cell, and the like. In one embodiment, the T-cell is a CD8$^+$ T-cell or a CD4$^+$ T-cell. T-cell lines are available from, e.g., the American Type Culture Collection (ATCC, Manassas, Va.), and the German Collection of Microorganisms and Cell Cultures (DSMZ) and include, for example, Jurkat cells (ATCC TIB-152), Sup-T1 cells (ATCC CRL-1942), RPMI 8402 cells (DSMZ ACC-290), Karpas 45 cells (DSMZ ACC-545), and derivatives thereof.

The T lymphocytes can be autologous cells, syngeneic cells or allogenic cells.

The one or more polynucleotides of the disclosure may be introduced into a cell using physical or chemical methods, for example, by transfection, transformation, or transduction. Many transfection techniques are known in the art and include, for example, calcium phosphate DNA co-precipitation (see, e.g., Murray E. J. (ed.), Methods in Molecular Biology, Vol. 7, Gene Transfer and Expression Protocols, Humana Press (1991)); DEAE-dextran; electroporation; cationic liposome-mediated transfection; tungsten particle-facilitated microparticle bombardment (Johnston, Nature, 346: 776-77 (1990)); and strontium phosphate DNA co-precipitation (Brash et al., Mol. Cell Biol., 7: 2031-34 (1987)). Phage or viral vectors can be introduced into host cells, after growth of infectious particles in suitable packaging cells, many of which are commercially available.

In some embodiments, a retrovirus is used to deliver a polynucleotide encoding bi-specific CAR, T-cell engager (TE or BiTE), or both into T lymphocytes of the disclosure. Retroviruses are a common tool for gene delivery (Miller, 2000, Nature 357: 455-60). Non-limiting examples of retroviruses suitable for use in particular embodiments include Moloney murine leukemia virus (M-MuLV), Moloney murine sarcoma virus (MoMSV), Harvey murine sarcoma virus (HaMuSV), murine mammary tumor virus (MuMTV), gibbon ape leukemia virus (GaLV), feline leukemia virus (FLV), spumavirus, Friend murine leukemia virus, Murine Stem Cell Virus (MSCV) and Rous Sarcoma Virus (RSV)) and lentivirus. Non-limiting examples of lentiviruses include human immunodeficiency virus (e.g., HIV type 1 and HIV type 2), visna-maedi virus (VMV), caprine arthritis-encephalitis virus (CAEV), equine infectious anemia virus (EIAV), feline immunodeficiency virus (FIV), bovine immune deficiency virus (BIV), and simian immunodeficiency virus (SIV).

T lymphocytes of the disclosure can be maintained with the use of cytokines such as, for example, IL-2, IL-4, IL-7, IL-9, IL-15 and IL-21.

T lymphocytes of the disclosure can be contacted with a population of cancer cells (e.g., GBM cells) ex vivo, in vivo, or in vitro. For example, the T lymphocytes described herein can be cultured ex vivo under conditions to express the bi-specific CAR and T-cell engager (TE or BiTE), and then directly transferred into a subject (e.g., a mammal such as a human) affected by cancer (e.g., a solid tumor such as GBM). Such a cell transfer method is referred to in the art as "adoptive cell transfer (ACT)," in which immune-derived cells are passively transferred into a new recipient host to transfer the functionality of the donor immune-derived cells to the new host.

Adoptive cell transfer methods to treat various types of cancers are known in the art and disclosed in, for example, Gattinoni et al., Nat. Rev. Immunol, 6(5): 383-93 (2006); June, J. Clin. Invest., 117(6): 1466-76 (2007); Rapoport et al., Blood, 117(3): 788-97 (2011); and Barber et al., Gene Therapy, 18: 509-16 (2011)).

The T lymphocytes of the disclosure may be introduced into a mammal, e.g., a human, using a variety of techniques and reagents known to those of skill in the art. In some embodiments, the T lymphocytes are introduced at the site of the tumor. In some embodiments, the T lymphocytes are modified to hone to the cancer. The number of cells that are employed will depend upon circumstances, such as the purpose for the introduction, the lifetime of the T lymphocytes, the number of administrations, etc.

Compositions, Pharmaceutical Compositions, and Kits

In another aspect, the disclosure provides a composition comprising any one or more of the polynucleotides, vectors, fusion proteins, host cells, or T lymphocytes described herein. In some embodiments, the composition comprises any one or more of the T lymphocytes described herein.

In another aspect, the disclosure provides a pharmaceutical composition comprising any one or more of the composition described herein and a pharmaceutically acceptable carrier, excipient, stabilizer, diluent or tonifier.

In certain embodiments, the composition or pharmaceutical further comprises a cryopreservation medium comprising about 2%, about 5%, or about 10% dimethyl sulfoxide (DMSO), wherein the cryopreservation medium is substantially free of serum.

In some embodiments, the composition or pharmaceutical composition is in a storage vial.

In another aspect, the disclosure provides a composition comprising T lymphocytes, wherein at least a portion of the T lymphocytes comprise:
- a first polynucleotide comprising a sequence encoding a CAR that is capable of binding to one or more first TAAs, and a second polynucleotide comprising a sequence encoding a T-cell engager (TE or BiTE) that is capable of binding to T-cell and a second TAA; or
- a third polynucleotide comprising a sequence encoding a fusion protein of a CAR that is capable of binding to one or more first TAA, and a T-cell engager (TE or BiTE) that is capable of binding to T-cell and a second TAA.

In another aspect, the disclosure provides a T lymphocyte comprising a first polynucleotide comprising a sequence encoding a T-cell engager (TE or BiTE) that is capable of binding to T-cell and a second TAA epitope. In some embodiments, the T lymphocyte comprises a second polynucleotide comprising a sequence encoding a CAR that is capable of binding to one or more first TAA. In some embodiments, each of the first and second polynucleotides is independently provided herein. In some embodiments, the first and second polynucleotides are connected. In some embodiments, the first and second polynucleotides are separated.

In some embodiments, the T-cell engager is capable of binding to CD2, CD3, VLA-1, CD8, CD4, CCR6, CXCR5, CD25, CD31, CD45RO, CD197, CD127, CD38, CD27, CD196, CD277, or CXCR3. In certain embodiments, the T-cell engager is capable of binding to CD2, CD3, CD31, or CD277. In particular embodiments, the T-cell engager is capable of binding to CD3.

In some embodiments, the one or more first TAAs and the second TAA each independently is expressed on a hematologic cancer (e.g., leukemia, lymphoma, myeloma) cell. Hematologic cancers that can be treated according to the methods described herein include leukemias (e.g., acute leukemias, chronic leukemias), lymphomas (e.g., B-cell lymphoma, T-cell lymphoma) and multiple myeloma. Accordingly, in some embodiments, the one or more first TAAs, the second TAA, or both are expressed on a hematologic cancer cell selected from leukemia (e.g., acute leukemias, chronic leukemias), lymphoma (e.g., B-cell lymphoma, T-cell lymphoma) and multiple myeloma cells.

In some embodiments, the one or more first TAAs and the second TAA each independently is expressed on a solid tumor cell (e.g., a tumor of the breast, lung, prostate, colon, bladder, ovary, kidney, stomach, colon, rectum, testes, head and/or neck, pancreas, brain, skin). Accordingly, in some embodiments, the one or more first TAAs and the second TAA each independently is expressed on a solid tumor cell selected from breast, lung, prostate, colon, bladder, ovarian, renal, gastric, rectal, colorectal, testicular, head and neck, pancreatic, brain and skin cancer cells.

In some embodiments, the one or more first TAAs are each independently selected from colon cancer antigen 19.9; a gastric cancer mucin; antigen 4.2; glycoprotein A33 (gpA33); ADAM-9; gastric cancer antigen AH6; ALCAM; malignant human lymphocyte antigen APO-1; cancer antigen B1; B7 H3; beta-catenin; blood group ALeb/Ley; Burkitt's lymphoma antigen-38.13, colonic adenocarcinoma antigen C14; ovarian carcinoma antigen CA125; Carboxypeptidase M; CD5; CD19; CD20; CD22; CD23; CD25; CD27; CD30; CD33; CD36; CD45; CD46; CD52; CD79a/CD79b; CD103; CD317; CDK4; carcinoembryonic antigen (CEA); CEACAM5; CEACAM6; C017-iA; CO-43 (blood group Leb); CO-514 (blood group Lea); CTA-1; CTLA4; Cytokeratin 8; antigen D1.1; antigen D 156-22; DR5; Ei series (blood group B); EGFR (Epidermal Growth Factor Receptor); Ephrin receptor A2 (EphA2); ErbB1; ErbB3; ErbB4; GAGE-1; GAGE-2; GD2/GD3/GM2; lung adenocarcinoma antigen F3; antigen FC10.2; G49, ganglioside GD2; ganglioside GD3; ganglioside GM2; ganglioside GM3; GD2; GD3; GICA 19-9; GM2; gpOO; glypican-3 (GPC3); human leukemia T cell antigen Gp37; melanoma antigen gp75; gpA33; HER2 antigen (e.g., pi85 HER2); human milk fat globule antigen (HMFG); human papillomavirus E6/human papillomavirus-E7; high molecular weight melanoma antigen (IMW MAA); I antigen (differentiation antigen) I(Ma); Integrin Alpha-V-Beta-6 IntegrinP6 (ITGB6); Interleukin-13; Receptor a2 (IL13Rα2); JAM-3; KID3; KID31; KS 1/4 pan carcinoma antigen; human lung carcinoma antigens L6 and L20; LEA; LUCA-2; Mi:22:25:8; M18; M39; MAGE-1; MAGE-3; MART; MUC-1; MUM-1; Myl; N acetylglucosaminyltransferase; neoglycoprotein; NS-10; OFA-1; OFA-2; Oncostatin M; p15; melanoma-associated antigen p97; polymorphic epithelial mucin (PEM); polymorphic epithelial mucin antigen (PEMA); PIPA; prostate-specific antigen (PSA); prostate-specific membrane antigen (PSMA); prostatic acid phosphate; R2 4; RORi; sphingolipids; SSEA-1; SSEA-3; SSEA-4; sTn; T cell receptor derived peptide; T 5A7; TAG-72; TL5 (blood group A); TNF-α receptor; TNF-β receptor; TNF-γ receptor; TRA-1-85 (blood group H); Transferrin Receptor; tumor-specific transplantation antigen (TSTA), oncofetal antigen-alpha-fetoprotein (AFP); VEGF; VEGFR, VEP8; VEP9; VIMN-D5; and Y hapten, Ley.

In some embodiments, the one or more first TAAs are each independently selected from interleukin-13 receptor subunit alpha-2 (IL13Rα2), human epidermal growth factor receptor 2 (HER2), epidermal growth factor receptor (EGFR), EGFR variant III (EGFRvIII), glypican-3 (GPC3) and combinations thereof.

In some embodiments, the second TAA is IL13Rα2, HER2, EGFR, EGFRvIII, or GPC3.

In another aspect, the disclosure provides a composition comprising T lymphocytes, wherein at least a portion of the T lymphocytes comprise:
a polynucleotide comprising a sequence encoding a bi-specific CAR that is capable of binding to HER2 and IL13Rα2, and a second polynucleotide comprising a sequence encoding a T-cell engager (TE or BiTE) that is capable of binding to CD3 and a TAA;
a third polynucleotide comprising a sequence encoding a fusion protein of a bi-specific CAR that is capable of binding to HER2 and IL13Rα2, and a T-cell engager (TE or BiTE) that is capable of binding to CD3 and a TAA;
or a combination thereof.

In some embodiments, the TAA is a glioblastoma tumor antigen.

In some embodiments, the first polynucleotide is any one of the polynucleotides encoding a bi-specific CAR that targets HER2 and IL13Rα2, described herein. In some embodiments, the second polynucleotide is any one of the polynucleotides encoding a T-cell engager (TE or BiTE) that is capable of binding to CD3 and a TAA (e.g., a glioblastoma tumor antigen) described herein. In some embodiments, the third polynucleotide is any one of the polynucleotides encoding a dual-CAR and T-cell engager (TE or BiTE) fusion protein described herein.

In another aspect, the disclosure provides a composition comprising T lymphocytes, wherein at least a portion of the T lymphocytes comprise:
a polynucleotide comprising a sequence encoding a bi-specific CAR that is capable of binding to HER2, and a second polynucleotide comprising a sequence encoding a T-cell engager (TE or BiTE) that is capable of binding to CD3 and a TAA; or
a third polynucleotide comprising a sequence encoding a fusion protein of a bi-specific CAR that is capable of binding to HER2, and a T-cell engager (TE or BiTE) that is capable of binding to CD3 and a TAA.

In some embodiments, the T lymphocyte comprises the polynucleotide comprising a sequence encoding a bi-specific CAR that is capable of binding to HER2, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets HER2 described herein. In some embodiments, the second polynucleotide is any one of the polynucleotides encoding a T-cell engager (TE or BiTE) that is capable of binding to CD3 and a TAA described herein.

In some embodiments, the T lymphocyte comprises a third polynucleotide comprising a sequence encoding a fusion protein of a bi-specific CAR that is capable of binding to HER2, and a T-cell engager (TE or BiTE) that is capable of binding to CD3 and a TAA. In some embodiments, the third polynucleotide is any one of the polynucleotides encoding a dual-CAR and T-cell engager (TE or BiTE) fusion protein described herein.

In some embodiments, the T lymphocyte expresses (e.g., secrets) the bi-specific CAR that is capable of binding to HER2.

In some embodiments, the bi-specific CAR is capable of binding to two epitopes of one HER2. In some embodiments, the bi-specific CAR is capable of binding to two HER2.

In another aspect, the disclosure provides a composition comprising T lymphocytes, wherein at least a portion of the T lymphocytes comprise:
 a polynucleotide comprising a sequence encoding a bi-specific CAR that is capable of binding to EGFR or EGFRvIII, and a second polynucleotide comprising a sequence encoding a T-cell engager (TE or BiTE) that is capable of binding to CD3 and a TAA; or
 a third polynucleotide comprising a sequence encoding a fusion protein of a bi-specific CAR that is capable of binding to EGFR or EGFRvIII, and a T-cell engager (TE or BiTE) that is capable of binding to CD3 and a TAA.

In some embodiments, the T lymphocyte comprises the polynucleotide comprising a sequence encoding a bi-specific CAR that is capable of binding to EGFR or EGFRvIII, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets EGFR or EGFRvIII described herein. In some embodiments, the second polynucleotide is any one of the polynucleotides encoding a T-cell engager (TE or BiTE) that is capable of binding to CD3 and a TAA described herein.

In some embodiments, the T lymphocyte comprises a third polynucleotide comprising a sequence encoding a fusion protein of a bi-specific CAR that is capable of binding to EGFR or EGFRvIII, and a T-cell engager (TE or BiTE) that is capable of binding to CD3 and a TAA. In some embodiments, the third polynucleotide is any one of the polynucleotides encoding a dual-CAR and T-cell engager (TE or BiTE) fusion protein described herein.

In some embodiments, the T lymphocyte expresses (e.g., secrets) the bi-specific CAR that is capable of binding to EGFR or EGFRvIII.

In some embodiments, the bi-specific CAR is capable of binding to two epitopes of one EGFR or EGFRvIII. In some embodiments, the bi-specific CAR is capable of binding to two EGFRs or EGFRvIIIs.

In another aspect, the disclosure provides a composition comprising T lymphocytes, wherein at least a portion of the T lymphocytes comprise:
 a polynucleotide comprising a sequence encoding a bi-specific CAR that is capable of binding to GPC3, and a second polynucleotide comprising a sequence encoding a T-cell engager (TE or BiTE) that is capable of binding to CD3 and a TAA; or
 a third polynucleotide comprising a sequence encoding a fusion protein of a bi-specific CAR that is capable of binding to GPC3, and a T-cell engager (TE or BiTE) that is capable of binding to CD3 and a TAA.

In some embodiments, the T lymphocyte comprises the polynucleotide comprising a sequence encoding a bi-specific CAR that is capable of binding to GPC3, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets GPC3 described herein. In some embodiments, the second polynucleotide is any one of the polynucleotides encoding a T-cell engager (TE or BiTE) that is capable of binding to CD3 and a TAA described herein.

In some embodiments, the T lymphocyte comprises a third polynucleotide comprising a sequence encoding a fusion protein of a bi-specific CAR that is capable of binding to GPC3, and a T-cell engager (TE or BiTE) that is capable of binding to CD3 and a TAA. In some embodiments, the third polynucleotide is any one of the polynucleotides encoding a dual-CAR and T-cell engager (TE or BiTE) fusion protein described herein.

In some embodiments, the T lymphocyte expresses (e.g., secrets) the bi-specific CAR that is capable of binding to GPC3.

In some embodiments, the bi-specific CAR is capable of binding to two epitopes of one GPC3. In some embodiments, the bi-specific CAR is capable of binding to two GPC3.

Suitable pharmaceutically acceptable carriers, excipients, or stabilizers are nontoxic to recipients at the dosages and concentrations employed (Remington's Pharmaceutical Sciences 16th edition, Osol, A. Ed. (1980)). Non-limiting examples of pharmaceutically acceptable carriers, excipients, stabilizers, diluents or tonifiers include buffers (e.g., phosphate, citrate, histidine), antioxidants (e.g., ascorbic acid or methionine), preservatives, proteins (e.g., serum albumin, gelatin or immunoglobulins); hydrophilic polymers, amino acids, carbohydrates (e.g., monosaccharides, disaccharides, glucose, mannose or dextrins); chelating agents (e.g., EDTA), sugars (e.g., sucrose, mannitol, trehalose or sorbitol), salt-forming counter-ions (e.g., sodium), metal complexes (e.g., Zn-protein complexes); non-ionic surfactants (e.g., Tween), PLURONICS™ and polyethylene glycol (PEG).

In some embodiments, the composition (e.g., pharmaceutical composition) of the disclosure is formulated for a suitable administration schedule and route. Non-limiting examples of administration routes include oral, rectal, mucosal, intravenous, intramuscular, subcutaneous and topical, etc. In some embodiments, the composition (e.g., pharmaceutical composition) of the disclosure is stored in the form of an aqueous solution or a dried formulation (e.g., lyophilized).

In some embodiments, the composition (e.g., pharmaceutical composition) is formulated to be administered by infusion (e.g., intracranial ventricular injection, intracranial infusion or intravenous infusion).

In some embodiments, the composition (e.g., pharmaceutical composition) is formulated to be administered with a second therapeutic agent as a combination therapy.

In another aspect, the disclosure provides a kit comprising a container and, optionally, an instruction for use, wherein the container comprises any one or more of the compositions or pharmaceutical compositions described herein.

METHODS OF USE

In another aspect, the disclosure provides use of any one or more of the polynucleotides, vectors, fusion proteins, host cells, T lymphocytes, compositions (e.g., pharmaceutical compositions), or kits described herein for the preparation of a medicament for treating cancer in a subject in need thereof.

In another aspect, the disclosure provides use of any one or more T lymphocytes, compositions (e.g., pharmaceutical compositions), or kits described herein for the preparation of a medicament for treating cancer in a subject in need thereof.

In another aspect, the disclosure provides any one or more of the polynucleotides, vectors, fusion proteins, host cells, T lymphocytes, compositions (e.g., pharmaceutical compositions), or kits described herein for use in treating cancer in a subject in need thereof.

In another aspect, the disclosure provides any one or more of the T lymphocytes, compositions (e.g., pharmaceutical compositions), or kits described herein for use in treating cancer in a subject in need thereof.

In another aspect, the disclosure provides a method of treating cancer in a subject in need thereof, comprising administering to the subject an effective dosage of any one or more of the T lymphocytes, compositions, or pharmaceutical compositions described herein.

In some embodiments, the cancer is a solid tumor, e.g., breast, lung, prostate, colon, bladder, ovary, kidney, stomach, colon, rectum, testes, head and/or neck, pancreas, brain, or skin cancer. Accordingly, in some embodiments, the cancer is a solid tumor cell selected from breast, lung, prostate, colon, bladder, ovarian, renal, gastric, rectal, colorectal, testicular, head and neck, pancreatic, brain and skin cancer.

In some embodiments, the cancer is a hematologic cancer, for example, leukemia, lymphoma, or myeloma. Hematologic cancers that can be treated according to the methods described herein include leukemias (e.g., acute leukemias, chronic leukemias), lymphomas (e.g., B-cell lymphoma, T-cell lymphoma) and multiple myeloma. Accordingly, in some embodiments, the cancer is a hematologic cancer cell selected from leukemia (e.g., acute leukemias, chronic leukemias), lymphoma (e.g., B-cell lymphoma, T-cell lymphoma) and multiple myeloma.

In certain embodiments, the solid tumor is a brain tumor, breast cancer, lung cancer or liver cancer. In some embodiments, the brain tumor is glioblastoma (GBM). In certain embodiments, the GBM is primary glioblastoma multiforme. In particular embodiments, the GBM is recurrent glioblastoma multiforme. In some embodiments, the brain tumor is a brain metastatic tumor. In certain embodiments, the brain metastatic tumor is non-small cell lung cancer brain metastases (NSCLCBM), small cell lung cancer brain metastases (SCLCBM), HER2-positive metastatic breast cancer or triple-negative breast cancer brain metastases (TNBCBM). In some embodiments, the liver cancer is hepatocellular carcinoma (HCC).

In another aspect, the disclosure provides use of any one of the compositions (e.g., polynucleotides, T lymphocytes) or pharmaceutical compositions described herein for the preparation of a medicament for treating a tumor (e.g., a solid tumor such as glioblastoma) in a subject in need thereof.

In another aspect, the disclosure provides a method of treating a subject in need thereof, comprising administering to the subject an effective dosage of T lymphocytes, wherein at least a portion of the T lymphocytes comprise:

a first polynucleotide comprising a sequence encoding a CAR that is capable of binding to one or more first TAAs, and a second polynucleotide comprising a sequence encoding a T-cell engager (TE or BiTE) that is capable of binding to T-cell and a second TAA; or a third polynucleotide comprising a sequence encoding a fusion protein of a CAR that is capable of binding to one or more first TAA, and a T-cell engager (TE or BiTE) that is capable of binding to T-cell and a second TAA.

In another aspect, the disclosure provides a T lymphocyte comprising a first polynucleotide comprising a sequence encoding a T-cell engager (TE or BiTE) that is capable of binding to T-cell and a second TAA epitope. In some embodiments, the T lymphocyte comprises a second polynucleotide comprising a sequence encoding a CAR that is capable of binding to one or more first TAA. In some embodiments, each of the first and second polynucleotides is independently provided herein. In some embodiments, the first and second polynucleotides are connected. In some embodiments, the first and second polynucleotides are separated.

In particular embodiments, the disclosure provides a method of treating a subject in need thereof, comprising administering to the subject an effective dosage of T lymphocytes, wherein at least a portion of the T lymphocytes comprise a polynucleotide comprising a sequence encoding a CAR that is capable of binding to one or more first TAAs, and a sequence encoding a T-cell engager (TE or BiTE) that is capable of binding to T-cell and a second TAA. In particular embodiments, the disclosure provides a method of treating a subject in need thereof, comprising administering to the subject an effective dosage of T lymphocytes, wherein at least a portion of the T lymphocytes comprise a first polynucleotide comprising a sequence encoding a CAR that is capable of binding to one or more first TAAs, and a second polynucleotide comprising a sequence encoding a T-cell engager (TE or BiTE) that is capable of binding to T-cell and a second TAA, where the first and second polynucleotides are separated.

In some embodiments, the T-cell engager is capable of binding to CD2, CD3, VLA-1, CD8, CD4, CCR6, CXCR5, CD25, CD31, CD45RO, CD197, CD127, CD38, CD27, CD196, CD277, or CXCR3. In certain embodiments, the T-cell engager is capable of binding to CD2, CD3, CD31, or CD277. In particular embodiments, the T-cell engager is capable of binding to CD3.

In some embodiments, the one or more first TAAs and the second TAA each independently is expressed on a hematologic cancer (e.g., leukemia, lymphoma, myeloma) cell. Hematologic cancers that can be treated according to the methods described herein include leukemias (e.g., acute leukemias, chronic leukemias), lymphomas (e.g., B-cell lymphoma, T-cell lymphoma) and multiple myeloma. Accordingly, in some embodiments, the one or more first TAAs, the second TAA, or both are expressed on a hematologic cancer cell selected from leukemia (e.g., acute leukemias, chronic leukemias), lymphoma (e.g., B-cell lymphoma, T-cell lymphoma) and multiple myeloma cells.

In some embodiments, the one or more first TAAs and the second TAA each independently is expressed on a solid tumor cell (e.g., a tumor of the breast, lung, prostate, colon, bladder, ovary, kidney, stomach, colon, rectum, testes, head and/or neck, pancreas, brain, skin). Accordingly, in some embodiments, the one or more first TAAs and the second TAA each independently is expressed on a solid tumor cell selected from breast, lung, prostate, colon, bladder, ovarian, renal, gastric, rectal, colorectal, testicular, head and neck, pancreatic, brain and skin cancer cells.

In some embodiments, the one or more first TAAs are each independently selected from colon cancer antigen 19.9; a gastric cancer mucin; antigen 4.2; glycoprotein A33 (gpA33); ADAM-9; gastric cancer antigen AH6; ALCAM; malignant human lymphocyte antigen APO-1; cancer antigen B1; B7 H3; beta-catenin; blood group ALeb/Ley; Burkitt's lymphoma antigen-38.13, colonic adenocarcinoma antigen C14; ovarian carcinoma antigen CA125; Carboxypeptidase M; CD5; CD19; CD20; CD22; CD23; CD25; CD27; CD30; CD33; CD36; CD45; CD46; CD52; CD79a/CD79b; CD103; CD317; CDK4; carcinoembryonic antigen (CEA); CEACAM5; CEACAM6; C017-iA; CO-43 (blood group Leb); CO-514 (blood group Lea); CTA-1; CTLA4; Cytokeratin 8; antigen D1.1; antigen D 156-22; DR5; Ei series (blood group B); EGFR (Epidermal Growth Factor Receptor); Ephrin receptor A2 (EphA2); ErbB1; ErbB3; ErbB4; GAGE-1; GAGE-2; GD2/GD3/GM2; lung adenocarcinoma antigen F3; antigen FC10.2; G49, ganglioside GD2; ganglioside GD3; ganglioside GM2; ganglioside GM3; GD2; GD3; GICA 19-9; GM2; gpOO; glypican-3 (GPC3); human leukemia T cell antigen Gp37; melanoma antigen gp75; gpA33; HER2 antigen (e.g., pi85 HER2); human milk fat globule antigen (HMFG); human papillomavirus E6/human papillomavirus-E7; high molecular weight melanoma antigen (HMW MAA); I antigen (differentiation antigen) I(Ma); Integrin Alpha-V-Beta-6 IntegrinP6 (ITGB6); Interleukin-13; Receptor a2 (IL13Rα2); JAM-3; KID3; KID31; KS 1/4 pan carcinoma antigen; human lung carcinoma antigens L6 and L20; LEA; LUCA-2; Mi:22:25:8; M18; M39; MAGE-1; MAGE-3; MART; MUC-1; MIUM-1; Myl; N acetylglucosaminyltransferase; neoglycoprotein; NS-10; OFA-1; OFA-2; Oncostatin M; p15; melanoma-associated antigen p97; polymorphic epithelial mucin (PEM); polymorphic epithelial mucin antigen (PEMA); PIPA; prostate-specific antigen (PSA); prostate-specific membrane antigen (PSMA); prostatic acid phosphate; R2 4; RORi; sphingolipids; SSEA-1; SSEA-3; SSEA-4; sTn; T cell receptor derived peptide; T 5A7; TAG-72; TL5 (blood group A); TNF-α receptor; TNF-β receptor; TNF-γ receptor; TRA-1-85 (blood group H); Transferrin Receptor; tumor-specific transplantation antigen (TSTA), oncofetal antigen-alpha-fetoprotein (AFP); VEGF; VEGFR; VEP8; VEP9; VIM-D5; and Y hapten, Ley.

In some embodiments, the one or more first TAAs are each independently selected from interleukin-13 receptor subunit alpha-2 (IL13Rα2), human epidermal growth factor receptor 2 (HER2), epidermal growth factor receptor (EGFR), EGFR variant III (EGFRvIII), glypican-3 (GPC3) and combinations thereof.

In some embodiments, the second TAA is IL13Rα2, HER2, EGFR, EGFRvIII, or GPC3.

In another aspect, the disclosure provides a method of treating a subject in need thereof, comprising administering to the subject an effective dosage of T lymphocytes, wherein at least a portion of the T lymphocytes comprise:
- a polynucleotide comprising a sequence encoding a bi-specific CAR that is capable of binding to HER2 and IL13Rα2, and a polynucleotide comprising a sequence encoding a T-cell engager (TE or BiTE) that is capable of binding to CD3 and a TAA; or
- a polynucleotide comprising a sequence encoding a fusion protein of a bi-specific CAR that is capable of binding to HER2 and IL13Rα2, and a T-cell engager (TE or BiTE) that is capable of binding to CD3 and a TAA.

In another aspect, the disclosure provides a method of treating a subject in need thereof, comprising administering to the subject an effective dosage of T lymphocytes, wherein at least a portion of the T lymphocytes comprise:
- a polynucleotide comprising a sequence encoding a bi-specific CAR that is capable of binding to HER2, and a second polynucleotide comprising a sequence encoding a T-cell engager (TE or BiTE) that is capable of binding to CD3 and a TAA; or
- a third polynucleotide comprising a sequence encoding a fusion protein of a bi-specific CAR that is capable of binding to HER2, and a T-cell engager (TE or BiTE) that is capable of binding to CD3 and a TAA.

In some embodiments, the bi-specific CAR is capable of binding to two epitopes of one HER2. In some embodiments, the bi-specific CAR is capable of binding to two HER2.

In another aspect, the disclosure provides a method of treating a subject in need thereof, comprising administering to the subject an effective dosage of T lymphocytes, wherein at least a portion of the T lymphocytes comprise:
- a polynucleotide comprising a sequence encoding a bi-specific CAR that is capable of binding to EGFR or EGFRvIII, and a second polynucleotide comprising a sequence encoding a T-cell engager (TE or BiTE) that is capable of binding to CD3 and a TAA; or
- a third polynucleotide comprising a sequence encoding a fusion protein of a bi-specific CAR that is capable of binding to EGFR or EGFRvIII, and a T-cell engager (TE or BiTE) that is capable of binding to CD3 and a TAA.

In some embodiments, the bi-specific CAR is capable of binding to two epitopes of one EGFR or EGFRvIII. In some embodiments, the bi-specific CAR is capable of binding to two EGFRs or EGFRvIIIs.

In another aspect, the disclosure provides a method of treating a subject in need thereof, comprising administering to the subject an effective dosage of T lymphocytes, wherein at least a portion of the T lymphocytes comprise:
- a polynucleotide comprising a sequence encoding a bi-specific CAR that is capable of binding to GPC3, and a second polynucleotide comprising a sequence encoding a T-cell engager (TE or BiTE) that is capable of binding to CD3 and a TAA; or
- a third polynucleotide comprising a sequence encoding a fusion protein of a bi-specific CAR that is capable of binding to GPC3, and a T-cell engager (TE or BiTE) that is capable of binding to CD3 and a TAA.

In some embodiments, the bi-specific CAR is capable of binding to two epitopes of one GPC3. In some embodiments, the bi-specific CAR is capable of binding to two GPC3.

In some embodiments, the TAA is a glioblastoma tumor antigen.

In some embodiments, the T lymphocytes are allogeneic or syngeneic T lymphocytes.

In some embodiments, the T lymphocytes are autologous T lymphocytes.

In some embodiments, the human subject is an infant (less than 1 year old). In some embodiments, the human subject is less than 11 years old. In some embodiments, the human subject is 11 years or older. In some embodiments, the human subject is 12 years or older. In some embodiments, the human subject is 12-17 years old. In some embodiments, the human subject is less than 18 years old. In some embodiments, the human subject is an adult (18 years or older). In some embodiments, the human subject is 40 years or older, e.g., at least: 45, 50, 55, 60, 65, 70, 75, 80, 85, 90 years old. In some embodiments, the human subject is elderly (65 years or older). In some embodiments, the human subject is 18 years or older.

A subject to be treated according to the methods described herein may be one who has been diagnosed with a particular condition, or one at risk of developing such conditions. Diagnosis may be performed by any method or technique known in the art. One skilled in the art will understand that a subject to be treated according to the present disclosure may have been subjected to standard tests or may have been identified, without examination, as one at risk due to the presence of one or more risk factors associated with the disease or condition.

In some embodiments, the mammalian subject has cancer.

In some embodiments, the cancer is a hematologic cancer. In some embodiments, the cancer is a hematologic cancer and the bi-specific CAR is capable of binding to (e.g., targets) CD19, CD20, CD22, CD30, CD33, CD123, CD138, BCMA, or a combination thereof.

In some embodiments, the hematologic cancer is leukemia.

In some embodiments, the leukemia is selected from acute lymphoblastic leukemia (ALL), acute myeloid leukemia (AML), chronic lymphocytic leukemia (CLL), chronic myeloid leukemia (CML), hairy cell leukemia (HCL), myelodysplastic syndromes (MDS), and combinations thereof.

In some embodiments, the hematologic cancer comprises lymphoma.

In some embodiments, the lymphoma comprises Hodgkin lymphoma.

In some embodiments, the Hodgkin lymphoma is selected from nodular sclerosis Hodgkin lymphoma (NSCHL), mixed cellularity Hodgkin lymphoma (MCcHL), lymphocyte-rich Hodgkin's disease (LRCHL), lymphocyte-depleted Hodgkin's disease (LDHL), and combinations thereof.

In some embodiments, the lymphoma comprises non-Hodgkin lymphoma (NHL).

In some embodiments, the non-Hodgkin lymphoma comprises a B cell lymphoma.

In some embodiments, the B cell lymphoma is selected from diffuse large B-cell lymphoma (DLBCL), primary mediastinal B cell lymphoma (PMBCL), follicular lymphoma (FL), small lymphocytic lymphoma (SLL), marginal zone lymphoma (MZL), mantle cell lymphoma (MCL), Waldenstrom's macroglobulinemia (WMG), Burkitt lymphoma (BL), and combinations thereof.

In some embodiments, the non-Hodgkin lymphoma comprises a T cell lymphoma.

In some embodiments, the T cell lymphoma is selected from peripheral T-cell lymphoma (PTCL), anaplastic large cell lymphoma (ALCL), angioimmunoblastic T-cell lymphoma (AITL), cutaneous T cell lymphoma, and combinations thereof.

In some embodiments, the hematologic cancer comprises multiple myeloma.

In some embodiments, the multiple myeloma is selected from light chain multiple myeloma (LCMM), non-secretory multiple myeloma (NSMM), solitary plasmacytoma (SP), extramedullary plasmacytoma (EMP), monoclonal gammopathy of undetermined significance (MGUS), smoldering Multiple Myeloma (SMM), Immunoglobulin D multiple myeloma (IgD MM), Immunoglobulin E (IgE) multiple myeloma, and combinations thereof.

In some embodiments, the cancer is a solid tumor.

In some embodiments, the solid tumor is a tumor of the breast, lung, prostate, colon, bladder, ovary, kidney, stomach, colon, rectum, testes, head and/or neck, pancreas, brain, skin, or a combination thereof.

In some embodiments, the solid tumor is selected from bladder cancer, brain cancer, breast cancer, cervical cancer, colon cancer, colorectal cancer, fallopian tube cancer, gastric cancer, genitourinary cancer, head and neck cancer, liver cancer, lung cancer, melanoma, nasopharyngeal carcinoma (NPC), pancreatic cancer, prostate cancer, ovarian cancer, rectal cancer, renal cancer, skin cancer, stomach cancer, testicular cancer, thyroid cancer, urethral cancer, and combinations thereof.

In some embodiments, the solid tumor is selected from breast cancer, squamous non-small cell lung cancer (NSCLC), non-squamous NSCLC, lung adenocarcinoma, mesothelioma, kidney clear cell carcinoma, kidney papillary cell carcinoma, hepatocellular carcinoma (HCC), castration-resistant prostate cancer, squamous cell carcinoma of the head and neck, carcinomas of the esophagus, carcinomas of the gastrointestinal tract, endometriosis, and combinations thereof. In certain embodiments, the solid tumor is selected from breast cancer, squamous non-small cell lung cancer (NSCLC), non-squamous NSCLC, lung adenocarcinoma, hepatocellular carcinoma (HCC), and combinations thereof. In particular embodiments, the solid tumor is breast cancer. In particular embodiments, the solid tumor is NSCLC. In particular embodiments, the solid tumor is lung adenocarcinoma. In particular embodiments, the solid tumor is mesothelioma. In particular embodiments, the solid tumor is HCC.

In some embodiments, the solid tumor is a metastatic lesion of the cancer.

In some embodiments, the cancer is a glioblastoma (GBM), breast cancer, or lung cancer. In some embodiments, the cancer is GBM. In some embodiments, the subject is newly diagnosed with glioblastoma. In some embodiments, the subject has relapsed from or is refractory to a prior glioblastoma therapy. In some embodiments, the cancer is breast cancer. In some embodiments, the breast cancer is HER2-positive breast cancer. In some embodiments, the cancer is lung cancer. In some embodiments, the lung cancer is brain metastatic lung cancer.

In some embodiments, at least about 10% of the T lymphocytes that are administered to the subject express the bi-specific CAR and the T-cell engager (TE or BiTE). For example, at least 15%, at least 20%, at least 25%, at least 30%, at least 35%, at least 40%, at least 45%, least 50%, at least 55%, at least 60%, at least 65%, at least 70% or at least 75% of the T lymphocytes that are administered to the subject express the bi-specific CAR and the T-cell engager (TE or BiTE). In some embodiments, about 10-80% of the T lymphocytes express the bi-specific CAR and the T-cell engager (TE or BiTE). For example, about: 10-75%, 15-75%, 15-70%, 20-70%, 20-65%, 25-65%, 25-60%, 30-60%, 30-55%, 35-55%, 35-50% or 40-50% of the T lymphocytes express the bi-specific CAR and the T-cell engager (TE or BiTE).

In some embodiments, at least 10% of the T lymphocytes express the bi-specific CAR. For example, at least 15%, at least 20%, at least 25%, at least 30%, at least 35%, at least 40%, at least 45%, least 50%, at least 55%, at least 60%, at least 65%, at least 70% or at least 75% of the T lymphocytes express the bi-specific CAR. In some embodiments, about 10-80% of the T lymphocytes express the bi-specific CAR. For example, about: 10-75%, 15-75%, 15-70%, 20-70%, 20-65%, 25-65%, 25-60%, 30-60%, 30-55%, 35-55%, 35-50% or 40-50% of the T lymphocytes express the bi-specific CAR.

In some embodiments, a T lymphocyte comprises 1-4 copies of a polynucleotide encoding each of the bi-specific CAR and the T-cell engager (TE or BiTE) per T lymphocyte. For example, the T lymphocyte can comprise about: 0, 1, 2, 3, or 4 or 1-4, 1-3, 1-2, 2-4 or 2-3 copies of a polynucleotide comprising each of the bi-specific CAR and the T-cell engager (TE or BiTE).

In some embodiments, the method is used for prophylactic therapy. In some embodiments, the method is used as first-line therapy. In some embodiments, the method is used as second-line therapy. In some embodiments, the method is used as third-line therapy.

In some embodiments, the method is used for treating cancer.

A therapeutic agent described herein can be administered via a variety of routes of administration, including, for example, oral, dietary, topical, transdermal, rectal, parenteral (e.g., intra-arterial, intravenous, intramuscular, subcutaneous injection, intradermal injection), intravenous infusion and inhalation (e.g., intrabronchial, intranasal or oral inhalation, intranasal drops) routes of administration, depending on the compound and the particular disease to be treated. Administration can be local or systemic as indicated. The preferred mode of administration can vary depending on the particular compound chosen.

In some embodiments, the T lymphocytes are administered as a single infusion (e.g., a single intracranial ventricular, intracranial, or intravenous infusion). In some embodiments, the T lymphocytes are administered as two or more infusions (e.g., intracranial ventricular, intracranial, or intravenous infusions, or a combination thereof).

In some embodiments, the method further comprises administering a therapeutically effective amount of a second therapeutic agent to the subject.

In some embodiments, the method further comprises administering to the subject a therapy (e.g., chemotherapy) before, during or after administration of the T lymphocytes, or a combination thereof. For example, a brief chemotherapy may be administered before CAR-T therapy to improve the efficacy.

In some embodiments, the method further comprises managing CAR-T therapy associated CRS and neurological toxicity during or after administration of the T lymphocytes.

Administration of the two or more therapeutic agents encompasses co-administration of the therapeutic agents in a substantially simultaneous manner, such as in a pharmaceutical combination. Alternatively, such administration encompasses co-administration in multiple containers, or separate containers (e.g., capsules, powders, and liquids) for each therapeutic agent. Such administration also encompasses use of each type of therapeutic agent in a sequential manner, either at approximately the same time or at different times. The composition described herein and the second therapeutic agent can be administered via the same administration route or via different administration routes.

In another aspect, the disclosure provides a method of inducing T cell-mediated cytolysis of tumor cells, comprising contacting the glioblastoma cells with an effective dosage of T lymphocytes, wherein at least a portion of the T lymphocytes comprise:
 a first polynucleotide comprising a sequence encoding a CAR that is capable of binding to one or more first TAAs, and a second polynucleotide comprising a sequence encoding a T-cell engager (TE or BiTE) that is capable of binding to T-cell and a second TAA; or
 a third polynucleotide comprising a sequence encoding a fusion protein of a CAR that is capable of binding to one or more first TAA, and a T-cell engager (TE or BiTE) that is capable of binding to T-cell and a second TAA.

In another aspect, the disclosure provides a T lymphocyte comprising a first polynucleotide comprising a sequence encoding a T-cell engager (TE or BiTE) that is capable of binding to T-cell and a second TAA epitope. In some embodiments, the T lymphocyte comprises a second polynucleotide comprising a sequence encoding a CAR that is capable of binding to one or more first TAA. In some embodiments, each of the first and second polynucleotides is independently provided herein. In some embodiments, the first and second polynucleotides are connected. In some embodiments, the first and second polynucleotides are separated.

In particular embodiments, the disclosure provides a method of inducing T cell-mediated cytolysis of tumor cells, comprising contacting the glioblastoma cells with an effective dosage of T lymphocytes, wherein at least a portion of the T lymphocytes comprise a polynucleotide comprising a sequence encoding a CAR that is capable of binding to one or more first TAAs, and a sequence encoding a T-cell engager (TE or BiTE) that is capable of binding to T-cell and a second TAA. In particular embodiments, the disclosure provides a method of treating a subject in need thereof, comprising administering to the subject an effective dosage of T lymphocytes, wherein at least a portion of the T lymphocytes comprise a first polynucleotide comprising a sequence encoding a CAR that is capable of binding to one or more first TAAs, and a second polynucleotide comprising a sequence encoding a T-cell engager (TE or BiTE) that is capable of binding to T-cell and a second TAA, where the first and second polynucleotides are separated.

In some embodiments, the T-cell engager is capable of binding to CD2, CD3, VLA-1, CD8, CD4, CCR6, CXCR5, CD25, CD31, CD45RO, CD197, CD127, CD38, CD27, CD196, CD277, or CXCR3. In certain embodiments, the T-cell engager is capable of binding to CD2, CD3, CD31, or CD277. In particular embodiments, the T-cell engager is capable of binding to CD3.

In some embodiments, the one or more first TAAs and the second TAA each independently is expressed on a hematologic cancer (e.g., leukemia, lymphoma, myeloma) cell. Hematologic cancers that can be treated according to the methods described herein include leukemias (e.g., acute leukemias, chronic leukemias), lymphomas (e.g., B-cell lymphoma, T-cell lymphoma) and multiple myeloma. Accordingly, in some embodiments, the one or more first TAAs, the second TAA, or both are expressed on a hematologic cancer cell selected from leukemia (e.g., acute leukemias, chronic leukemias), lymphoma (e.g., B-cell lymphoma, T-cell lymphoma) and multiple myeloma cells.

In some embodiments, the one or more first TAAs and the second TAA each independently is expressed on a solid tumor cell (e.g., a tumor of the breast, lung, prostate, colon, bladder, ovary, kidney, stomach, colon, rectum, testes, head and/or neck, pancreas, brain, skin). Accordingly, in some embodiments, the one or more first TAAs and the second TAA each independently is expressed on a solid tumor cell selected from breast, lung, prostate, colon, bladder, ovarian, renal, gastric, rectal, colorectal, testicular, head and neck, pancreatic, brain and skin cancer cells.

In some embodiments, the one or more first TAAs are each independently selected from colon cancer antigen 19.9; a gastric cancer mucin; antigen 4.2; glycoprotein A33 (gpA33); ADAM-9; gastric cancer antigen AH6; ALCAM; malignant human lymphocyte antigen APO-1; cancer antigen B1; B7 H3; beta-catenin; blood group ALeb/Ley; Burkitt's lymphoma antigen-38.13, colonic adenocarcinoma antigen C14; ovarian carcinoma antigen CA125; Carboxypeptidase M; CD5; CD19; CD20; CD22; CD23; CD25; CD27; CD30; CD33; CD36; CD45; CD46; CD52; CD79a/CD79b; CD103; CD317; CDK4; carcinoembryonic antigen (CEA); CEACAM5; CEACAM6; C017-iA; CO-43 (blood group Leb); CO-514 (blood group Lea); CTA-1; CTLA4; Cytokeratin 8; antigen D1.1; antigen D 156-22; DR5; Ei series (blood group B); EGFR (Epidermal Growth Factor Receptor); Ephrin receptor A2 (EphA2); ErbB1; ErbB3; ErbB4; GAGE-1; GAGE-2; GD2/GD3/GM2; lung adenocarcinoma antigen F3; antigen FC10.2; G49, ganglioside GD2; ganglioside GD3; ganglioside GM2; ganglioside GM3; GD2; GD3; GICA 19-9; GM2; gpOO; glypican-3 (GPC3); human leukemia T cell antigen Gp37; melanoma antigen gp75; gpA33; HER2 antigen (e.g., pi85 HER2); human milk fat globule antigen (HMFG); human papillomavirus E6/human papillomavirus-E7; high molecular weight melanoma antigen (IMW MAA); I antigen (differentiation antigen) I(Ma); Integrin Alpha-V-Beta-6 IntegrinP6 (ITGB6); Interleukin-13; Receptor a2 (IL13Rα2); JAM-3; KID3; KID31; KS 1/4 pan carcinoma antigen; human lung carcinoma antigens L6 and L20; LEA; LUCA-2; Mi:22:25:8; M18; M39; MAGE-1; MAGE-3; MART; MUC-1; MUM-1; Myl; N acetylglucosaminyltransferase; neoglycoprotein; NS-10; OFA-1; OFA-2; Oncostatin M; p15; melanoma-associated antigen p97; polymorphic epithelial mucin (PEM); polymorphic epithelial mucin antigen (PEMA); PIPA; prostate-specific antigen (PSA); prostate-specific membrane antigen (PSMA); prostatic acid phosphate; R2 4; RORi; sphingolipids; SSEA-1; SSEA-3; SSEA-4; sTn; T cell receptor derived peptide; T 5A7; TAG-72; TL5 (blood group A); TNF-α receptor; TNF-β receptor; TNF-γ receptor; TRA-1-85 (blood group H); Transferrin Receptor; tumor-specific transplantation antigen (TSTA), oncofetal antigen-alpha-fetoprotein (AFP); VEGF; VEGFR, VEP8; VEP9; VIMN-D5; and Y hapten, Ley.

In some embodiments, the one or more first TAAs are each independently selected from interleukin-13 receptor subunit alpha-2 (IL13Rα2), human epidermal growth factor receptor 2 (HER2), epidermal growth factor receptor (EGFR), EGFR variant III (EGFRvIII), glypican-3 (GPC3) and combinations thereof.

In some embodiments, the second TAA is IL13Rα2, HER2, EGFR, EGFRvIII, or GPC3.

In another aspect, the disclosure provides a method of inducing T cell-mediated cytolysis of tumor cells, comprising contacting the glioblastoma cells with an effective dosage of T lymphocytes, wherein at least a portion of the T lymphocytes comprise:
  a first polynucleotide comprising a sequence encoding a bi-specific CAR that is capable of binding to HER2 and IL13Rα2, and a second polynucleotide comprising a sequence encoding a T-cell engager (TE or BiTE) that is capable of binding to CD3 and a TAA; or
  a third polynucleotide comprising a sequence encoding a fusion protein of a bi-specific CAR that is capable of binding to HER2 and IL13Rα2, and a T-cell engager (TE or BiTE) that is capable of binding to CD3 and a TAA.

In some embodiments, the TAA is a glioblastoma tumor antigen.

In some embodiments, the first polynucleotide is any one of the polynucleotides encoding a bi-specific CAR that targets HER2 and IL13Rα2 described herein. In some embodiments, the second polynucleotide is any one of the polynucleotides encoding a T-cell engager (TE or BiTE) that is capable of binding to CD3 and a glioblastoma tumor antigen described herein. In some embodiments, the third polynucleotide is any one of the polynucleotides encoding a dual-CAR and T-cell engager (TE or BiTE) fusion protein described herein.

In another aspect, the disclosure provides a method of inducing T cell-mediated cytolysis of tumor cells, comprising contacting the glioblastoma cells with an effective dosage of T lymphocytes, wherein at least a portion of the T lymphocytes comprise:
  a first polynucleotide comprising a sequence encoding a bi-specific CAR that is capable of binding to HER2, and a second polynucleotide comprising a sequence encoding a T-cell engager (TE or BiTE) that is capable of binding to CD3 and a TAA; or
  a third polynucleotide comprising a sequence encoding a fusion protein of a bi-specific CAR that is capable of binding to HER2, and a T-cell engager (TE or BiTE) that is capable of binding to CD3 and a TAA.

In some embodiments, the T lymphocyte comprises the polynucleotide comprising a sequence encoding a bi-specific CAR that is capable of binding to HER2, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets HER2 described herein. In some embodiments, the second polynucleotide is any one of the polynucleotides encoding a T-cell engager (TE or BiTE) that is capable of binding to CD3 and a TAA described herein.

In some embodiments, the T lymphocyte expresses (e.g., secrets) the bi-specific CAR that is capable of binding to HER2.

In some embodiments, the bi-specific CAR is capable of binding to two epitopes of one HER2. In some embodiments, the bi-specific CAR is capable of binding to two HER2.

In another aspect, the disclosure provides a method of inducing T cell-mediated cytolysis of tumor cells, comprising contacting the glioblastoma cells with an effective dosage of T lymphocytes, wherein at least a portion of the T lymphocytes comprise:
  a first polynucleotide comprising a sequence encoding a bi-specific CAR that is capable of binding to EGFR or EGFRvIII, and a second polynucleotide comprising a sequence encoding a T-cell engager (TE or BiTE) that is capable of binding to CD3 and a TAA; or
  a third polynucleotide comprising a sequence encoding a fusion protein of a bi-specific CAR that is capable of binding to EGFR or EGFRvIII, and a T-cell engager (TE or BiTE) that is capable of binding to CD3 and a TAA.

In some embodiments, the T lymphocyte comprises the polynucleotide comprising a sequence encoding a bi-specific CAR that is capable of binding to EGFR or EGFRvIII, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets EGFR or EGFRvIII described herein. In some embodiments, the second polynucleotide is any one of the polynucleotides encoding a T-cell engager (TE or BiTE) that is capable of binding to CD3 and a TAA described herein.

In some embodiments, the T lymphocyte expresses (e.g., secretes) the bi-specific CAR that is capable of binding to EGFR or EGFRvIII.

In some embodiments, the bi-specific CAR is capable of binding to two epitopes of one EGFR or EGFRvIII. In some embodiments, the bi-specific CAR is capable of binding to two EGFRs or EGFRvIIIs.

In another aspect, the disclosure provides a method of inducing T cell-mediated cytolysis of tumor cells, comprising contacting the glioblastoma cells with an effective dosage of T lymphocytes, wherein at least a portion of the T lymphocytes comprise:
 a first polynucleotide comprising a sequence encoding a bi-specific CAR that is capable of binding to GPC3, and a second polynucleotide comprising a sequence encoding a T-cell engager (TE or BiTE) that is capable of binding to CD3 and a TAA; or
 a third polynucleotide comprising a sequence encoding a fusion protein of a bi-specific CAR that is capable of binding to GPC3, and a T-cell engager (TE or BiTE) that is capable of binding to CD3 and a TAA.

In some embodiments, the T lymphocyte comprises the polynucleotide comprising a sequence encoding a bi-specific CAR that is capable of binding to GPC3, and the second polynucleotide comprising a sequence encoding a T-cell engager (TE or BiTE) that is capable of binding to CD3 and a TAA. In some embodiments, the polynucleotide is any one of the polynucleotides encoding a bi-specific CAR that targets GPC3 described herein. In some embodiments, the second polynucleotide is any one of the polynucleotides encoding a T-cell engager (TE or BiTE) that is capable of binding to CD3 and a TAA described herein.

In some embodiments, the T lymphocyte expresses (e.g., secrets) the bi-specific CAR that is capable of binding to GPC3.

In some embodiments, the bi-specific CAR is capable of binding to two epitopes of one GPC3. In some embodiments, the bi-specific CAR is capable of binding to two GPC3.

In some embodiments, the tumor cells are solid tumor cells. In some embodiments, the tumor cells are glioblastoma cells, breast cancer cells or lung cancer cells. In some embodiments, the tumor cells are glioblastoma cells. In some embodiments, the tumor cells are breast cancer cells. In some embodiments, the breast cancer cells are HER2-positive breast cancer. In some embodiments, the tumor cells are lung cancer cells. In some embodiments, the lung cancer cells are brain metastatic lung cancer cells.

In some embodiments, the glioblastoma cells are in any of the subjects described herein, and contacting the glioblastoma cells with an effective dosage of T lymphocytes is performed by administering to the subject the effective dosage of T lymphocytes.

Dual-CAR Two-Arm-BiTE Engineered T Cells

In another aspect, the disclosure provides a T lymphocyte, wherein the T lymphocyte comprises a polynucleotide comprising a sequence encoding a fusion protein of a bi-specific CAR that is capable of binding to two TAAs (e.g., two different antigens expressed on the surface of a cancer cell) and a T-cell engager (TE or BiTE) that is capable of binding to T-cell (e.g., CD3) and a TAA.

In another aspect, the disclosure provides a polynucleotide, wherein the polynucleotide comprising a sequence encoding the fusion protein described herein.

In another aspect, the disclosure provides an expression vector, wherein the expression vector comprises the polynucleotide described herein.

In another aspect, the disclosure provides a host cell, wherein the host cell comprises the polynucleotide or expression vector of described herein.

In another aspect, the disclosure provides a composition comprising T lymphocytes, wherein at least a portion of the T lymphocytes comprise a polynucleotide comprising a sequence encoding a fusion protein of a bi-specific CAR and a T-cell engager (TE or BiTE) that is capable of binding to T-cell (e.g., CD3) and a TAA.

In another aspect, the disclosure provides a pharmaceutical composition, wherein the pharmaceutical composition comprises the composition described herein and a pharmaceutically acceptable carrier.

In another aspect, the disclosure provides a kit, wherein the kit comprises a container and optionally an instruction for use, wherein the container comprises the pharmaceutical composition described herein.

In another aspect, the disclosure provides use of a composition or pharmaceutical composition described herein, for the preparation of a medicament for treating a tumor described herein in a subject in need thereof described herein.

In another aspect, the disclosure provides a method of treating a tumor described herein in a subject in need thereof described herein, comprising administering to the subject an effective dosage of T lymphocytes, wherein at least a portion of the T lymphocytes comprise a polynucleotide comprising a sequence encoding a fusion protein of a bi-specific CAR and a T-cell engager (TE or BiTE) that is capable of binding to T-cell (e.g., CD3) and a TAA (e.g., a tumor antigen such as a glioblastoma tumor antigen).

In another aspect, the disclosure provides a method of inducing T cell-mediated cytolysis of tumor cells, comprising contacting the tumor cells with an effective dosage of T lymphocytes, wherein at least a portion of the T lymphocytes comprise a polynucleotide comprising a sequence encoding a fusion protein of a bi-specific CAR and a T-cell engager (TE or BiTE) that is capable of binding to T-cell (e.g., CD3) and a TAA (e.g., a tumor antigen such as a glioblastoma tumor antigen).

In some embodiments, the bi-specific CAR comprises an IL13 mutein linked to a HER2-binding scFv via a linker sequence.

In some embodiments, the bi-specific CAR comprises an IL13 mutein linked to a HER2-binding scFv via a linker sequence. In some embodiments, the IL13 mutein comprises an amino acid sequence that is at least 90% identical to the amino acid sequence of SEQ ID NO: 1. In some embodiments, the IL13 mutein comprises about 1-12 amino acid substitutions, relative to the amino acid sequence of SEQ ID NO: 1. In some embodiments, the IL13 mutein comprises the amino acid sequence of SEQ ID NO: 1.

In some embodiments, the HER2-binding scFv comprises an amino acid sequence that is at least 90% identical to the amino acid sequence of SEQ ID NO: 2, 3 or 4, or a combination thereof. In some embodiments, the HER2-binding scFv comprises an amino acid sequence that is at least 90% identical to the amino acid sequence of SEQ ID NO: 4. In some embodiments, the HER2-binding scFv comprises about 1-25 amino acid substitutions, relative to the amino acid sequence of SEQ ID NO: 2, 3 or 4, or a combination of thereof. In some embodiments, the HER2-binding scFv comprises about 1-25 amino acid substitutions, relative to the amino acid sequence of SEQ ID NO: 4. In some embodiments, the HER2-binding scFv comprises the amino acid sequence of SEQ ID NO: 2, 3 or 4. In some embodiments, the HER2-binding scFv comprises the amino acid sequence of SEQ ID NO: 4.

In some embodiments, the bi-specific CAR further comprises:
a CD8α signal peptide;
a CD8α hinge;
a CD28 transmembrane domain;
a 4-1BB costimulatory domain; or
a CD3ζ signaling domain,
or a combination thereof.

In some embodiments:
the linker comprises an amino acid sequence that is at least 90% identical to the amino acid sequence of SEQ ID NO: 5;
the CD8α signal peptide comprises an amino acid sequence that is at least 90% identical to the amino acid sequence of SEQ ID NO: 6;
the CD8α hinge comprises an amino acid sequence that is at least 90% identical to the amino acid sequence of SEQ ID NO: 7;
the CD28 transmembrane domain comprises an amino acid sequence that is at least 90% identical to the amino acid sequence of SEQ ID NO: 8;
the 4-1BB costimulatory domain comprises an amino acid sequence that is at least 90% identical to the amino acid sequence of SEQ ID NO: 9; or
the CD3ζ signaling domain comprises an amino acid sequence that is at least 90% identical to the amino acid sequence of SEQ ID NO: 10,
or a combination thereof.

In some embodiments:
the linker comprises about 1 or 2 amino acid substitutions, relative to the amino acid sequence of SEQ ID NO: 5;
the CD8α signal peptide comprises about 1 or 2 amino acid substitutions, relative to the amino acid sequence of SEQ ID NO: 6;
the CD8α hinge comprises about 1-5 amino acid substitutions, relative to the amino acid sequence of SEQ ID NO: 7;
the CD28 transmembrane domain comprises about 1-3 amino acid substitutions, relative to the amino acid sequence of SEQ ID NO: 8;
the 4-1BB costimulatory domain comprises about 1-5 amino acid substitutions, relative to the amino acid sequence of SEQ ID NO: 9; or
the CD3ζ signaling domain comprises about 1-12 amino acid substitutions, relative to the amino acid sequence of SEQ ID NO: 10, or
a combination thereof.

In some embodiments:
the linker comprises the amino acid sequence of SEQ ID NO: 5;
the CD8α signal peptide comprises the amino acid sequence of SEQ ID NO: 6;
the CD8α hinge comprises the amino acid sequence of SEQ ID NO: 7;
the CD28 transmembrane domain comprises the amino acid sequence of SEQ ID NO: 8;
the 4-1BB costimulatory domain comprises the amino acid sequence of SEQ ID NO: 9; or
the CD3ζ signaling domain comprises the amino acid sequence of SEQ ID NO: 10,
or a combination thereof.

In some embodiments, the T-cell engager (TE or BiTE) comprises a CD3-binding scFv. In some embodiments, the CD3-binding scFv comprises an amino acid sequence that is at least 90% identical to the amino acid sequence of SEQ ID NO: 14. In some embodiments, the CD3-binding scFv comprises about 1-25 amino acid substitutions, relative to the amino acid sequence of SEQ ID NO: 14. In some embodiments, the CD3-binding scFv comprises the amino acid sequence of SEQ ID NO: 14.

In some embodiments, the TAA is an EGFR antigen. In some embodiments, the TAA is an EGFRvIII antigen.

In some embodiments, the T-cell engager (TE or BiTE) comprises:
at least one EGFR-binding nanobody linked to the CD3-binding scFv via a linker sequence comprising GGGGS (SEQ ID NO: 18); or
at least one EGFRvIII-binding nanobody linked to the CD3-binding scFv via a linker sequence comprising GGGGS (SEQ ID NO: 18).

In some embodiments, the T-cell engager (TE or BiTE) comprises:
at least two EGFR-binding nanobodies;
at least two EGFRvIII-binding nanobodies; or
at least one EGFR-binding nanobody and at least one EGFRvIII-binding nanobody.

In some embodiments:
the at least one EGFR-binding nanobody comprises an amino acid sequence that is at least 90% identical to the amino acid sequence of SEQ ID NO: 15, 16 or 17, or a combination of thereof, or
the at least one EGFRvIII-binding nanobody comprises an amino acid sequence that is at least 90% identical to the amino acid sequence of SEQ ID NO: 15, 16 or 17, or a combination of thereof.

In some embodiments, the T-cell engager (TE or BiTE) further comprises a signal peptide and a 6× His tag sequence (SEQ ID NO: 20). In some embodiments, the signal peptide comprises an amino acid sequence that is at least 90% identical to the amino acid sequence of SEQ ID NO: 19. In some embodiments, the signal peptide comprises an amino acid sequence that is at least 90% identical to the amino acid sequence of SEQ ID NO: 19. In some embodiments, the signal peptide comprises about 1 or 2 amino acid substitutions, relative to the amino acid sequence of SEQ ID NO:19.

In some embodiments, the T-cell engager (TE or BiTE) comprises an amino acid sequence that is at least 90% identical to the amino acid sequence of SEQ ID NO: 21, 22, 23, 24, 25, 26, 27, 109, 110, 111, 176, 177, 178 or 292. In some embodiments, the T-cell engager (TE or BiTE) comprises about 1-40 amino acid substitutions, relative to the amino acid sequence of SEQ ID NO: 21, 22, 23, 109, 110 or 111, or a combination of thereof. In some embodiments, the T-cell engager (TE or BiTE) comprises about 1-55 amino acid substitutions, relative to the amino acid sequence of SEQ ID NO: 24, 25, 26, 27, 176, 177, 178 or 292, or a combination of thereof. In some embodiments, the T-cell engager (TE or BiTE) comprises the amino acid sequence of SEQ ID NO: 21, 22, 23, 24, 25, 26, 27, 176, 177, 178 or 292.

In some embodiments, the T-cell engager (TE or BiTE) comprises:
an EGFR antibody linked to the CD3-binding scFv via a linker sequence comprising GGGGS (SEQ ID NO: 16); or
an EGFRvIII antibody linked to the CD3-binding scFv via a linker sequence comprising GGGGS (SEQ ID NO: 16).

In some embodiments:
the EGFR antibody comprises an amino acid sequence that is at least 90% identical to the amino acid sequence of SEQ ID NO: 29; or
the EGFRvIII antibody comprises an amino acid sequence that is at least 90% identical to the amino acid sequence of SEQ ID NO: 29.

In some embodiments:
the EGFR antibody comprises about 1-25 amino acid substitutions, relative to the amino acid sequence of SEQ ID NO: 29; or
the EGFRvIII antibody comprises about 1-25 amino acid substitutions, relative to the amino acid sequence of SEQ ID NO: 29.

In some embodiments:
the EGFR antibody comprises the amino acid sequence of SEQ ID NO: 29; or
the EGFRvIII antibody comprises the amino acid sequence of SEQ ID NO: 29.

In some embodiments, the fusion protein further comprises a self-cleaving T2A Peptide (SEQ ID NO: 28).

In some embodiments, the fusion protein comprises an amino acid sequence that is at least 90% identical to the amino acid sequence of SEQ ID NO: 31, 32, 33, 34, 35, 36, 37 or 38, or a combination of thereof.

In some embodiments, the fusion protein comprises about 1-100 amino acid substitutions, relative to the amino acid sequence of SEQ ID NO: 31, 32, 33, 34, 35, 36, 37 or 38, or a combination of thereof. In some embodiments, the fusion protein comprises about 1-100 amino acid substitutions, relative to the amino acid sequence of SEQ ID NO: 37. In some embodiments, the fusion protein comprises the amino acid sequence of SEQ ID NO: 31, 32, 33, 34, 35, 36, 37 or 38. In some embodiments, the fusion protein comprises the amino acid sequence of SEQ ID NO: 37.

In another aspect, the disclosure provides a polypeptide comprising an amino acid sequence that is at least 60% identical to at least one amino acid sequence set forth in SEQ ID NOs: 2-4, 15-17 and 242-291. For example, the sequence identity can be at least about: 65%, 70%, 75%, 80%, 85%, 90%, 91%, 92%, 93%, 94%, 95%, 96%, 97%, 98% or 99%. In some embodiments, the sequence identity is about: 60%, 65%, 70%, 75%, 80%, 85%, 90%, 91%, 92%, 93%, 94%, 95%, 96%, 97%, 98% or 99%. In some embodiments, the sequence identity is about: 60-99%, 65-99%, 65-95%, 70-99%, 70-98%, 70-95%, 70-90%, 75-98%, 75-97%, 75-90%, 75-85%, 80-97%, 80-96%, 80-85%, 85-96%, 85-95% or 90-95%. In particular embodiments, the sequence identity is at least 90% (e.g., 91%, 92%, 93%, 94%, 95%, 96%, 97%, 98% or 99%).

In some embodiments, the polypeptide comprises at least one amino acid substitution, relative to at least one amino acid sequence set forth in SEQ ID NO: 2-4, 15-17 and 242-291. In some embodiments, the at least one amino acid substitution is at least: 2, 3, 4, 5, 6, 7, 8, 9, 10, 11 or 12 amino acid substitutions. In certain embodiments, the at least one amino acid substitution is about 1-12 amino acid substitutions, for example, about: 1-11, 2-11, 2-10, 3-10, 3-9, 4-9, 4-8, 5-8, 5-7 or 6-7 amino acid substitutions.

In particular embodiments, the polypeptide comprises an amino acid sequence that is identical to one amino acid sequence set forth in SEQ ID NOs: 2-4, 15-17 and 242-291.

Unless otherwise defined, all terms of art, notations and other scientific terms or terminology used herein are intended to have the meanings commonly understood by those of skill in the art to which this disclosure pertains. In some cases, terms with commonly understood meanings are defined herein for clarity and/or for ready reference, and the inclusion of such definitions herein should not necessarily be construed to represent a substantial difference over what is generally understood in the art. It will be further understood that terms, such as those defined in commonly used dictionaries, should be interpreted as having a meaning that is consistent with their meaning in the context of the relevant art and/or as otherwise defined herein.

In an additional aspect, the disclosure provides a polypeptide that specifically binds GPC3, wherein the polypeptide comprises a heavy chain complementarity determining region 1 (HCDR1), a heavy chain complementarity determining region 2 (HCDR2) and a heavy chain complementarity determining region 3 (HCDR3), each comprising an amino acid sequence that is at least 90% identical to the amino acid sequence of a HCDR1, HCDR2 and HCDR3, respectively, of a heavy chain variable region (VH) amino acid sequence set forth in SEQ ID NO: 284, SEQ ID NO: 286 or SEQ ID NO: 289. In some embodiments, the sequence identity is at least: 91%, 92%, 93%, 94%, 95%, 96%, 97%, 98% or 99%. In some embodiments, the HCDR1, HCDR2 and HCDR3 are identical to the HCDR1, HCDR2 and HCDR3, respectively, of the VH amino acid sequence set forth in SEQ ID NO: 284, SEQ ID NO: 286 or SEQ ID NO: 289

In certain embodiments, the HCDR1, HCDR2 and HCDR3 are at least 90% (e.g., at least: 91%, 92%, 93%, 94%, 95%, 96%, 97%, 98% or 99%) identical the amino acid sequences set forth in:
SEQ ID NO: 303, SEQ ID NO: 304 and SEQ ID NO: 305, respectively;
SEQ ID NO: 306, SEQ ID NO: 307 and SEQ ID NO: 308, respectively;
SEQ ID NO: 309, SEQ ID NO: 310 and SEQ ID NO: 308, respectively;
SEQ ID NO: 311, SEQ ID NO: 312 and SEQ ID NO: 313, respectively;
SEQ ID NO: 314, SEQ ID NO: 315 and SEQ ID NO: 316, respectively;
SEQ ID NO: 317, SEQ ID NO: 318 and SEQ ID NO: 316, respectively;
SEQ ID NO: 319, SEQ ID NO: 320 and SEQ ID NO: 321, respectively;
SEQ ID NO: 322, SEQ ID NO: 323 and SEQ ID NO: 324, respectively; or
SEQ ID NO: 325, SEQ ID NO: 326 and SEQ ID NO: 324, respectively.

In some embodiments, the HCDR1, HCDR2 and HCDR3 are identical the amino acid sequences set forth in:
SEQ ID NO: 303, SEQ ID NO: 304 and SEQ ID NO: 305, respectively;
SEQ ID NO: 306, SEQ ID NO: 307 and SEQ ID NO: 308, respectively;
SEQ ID NO: 309, SEQ ID NO: 310 and SEQ ID NO: 308, respectively;
SEQ ID NO: 311, SEQ ID NO: 312 and SEQ ID NO: 313, respectively;
SEQ ID NO: 314, SEQ ID NO: 315 and SEQ ID NO: 316, respectively;
SEQ ID NO: 317, SEQ ID NO: 318 and SEQ ID NO: 316, respectively;
SEQ ID NO: 319, SEQ ID NO: 320 and SEQ ID NO: 321, respectively;
SEQ ID NO: 322, SEQ ID NO: 323 and SEQ ID NO: 324, respectively; or
SEQ ID NO: 325, SEQ ID NO: 326 and SEQ ID NO: 324, respectively.

In certain embodiments, the amino acid sequence of the polypeptide is at least 85% (e.g., at least: 86%, 87%, 88%, 89%, 90%, 91%, 92%, 93%, 94%, 95%, 96%, 97%, 98% or 99%) identical to the amino acid sequence set forth in SEQ ID NO: 284, SEQ ID NO: 286 or SEQ ID NO: 289. In particular embodiments, the amino acid sequence of the polypeptide is identical to the amino acid sequence set forth in SEQ ID NO: 284, SEQ ID NO: 286 or SEQ ID NO: 289.

In some embodiments, the polypeptide is a nanobody.

Terminology

Certain terms used herein is for the purpose of describing particular embodiments only and is not intended to be limiting.

As used herein, the term "a," "an," or "the" should be understood to include plural reference unless the context clearly indicates otherwise.

As used herein, unless the context requires otherwise, the term "comprise," and variations such as "comprises" and "comprising", will be understood to imply the inclusion of, e.g., a stated integer or step or group of integers or steps, but not the exclusion of any other integer or step or group of integer or step. As used herein, the term "comprising" can be substituted with the term "containing" or "including."

As used herein, "consisting of" excludes any element, step, or ingredient not specified in the claim element. As used herein, "consisting essentially of" does not exclude materials or steps that do not materially affect the basic and novel characteristics of the claim. Any of the terms "comprising," "containing," "including," and "having," whenever used herein in the context of an aspect or embodiment of the disclosure, can in some embodiments, be replaced with the term "consisting of," or "consisting essentially of" to vary scopes of the disclosure.

As used herein, the conjunctive term "and/or" between multiple recited elements is understood as encompassing both individual and combined options. For instance, where two elements are conjoined by "and/or," a first option refers to the applicability of the first element without the second. A second option refers to the applicability of the second element without the first. A third option refers to the applicability of the first and second elements together. Any one of these options is understood to fall within the meaning, and, therefore, satisfy the requirement of the term "and/or" as used herein. Concurrent applicability of more than one of the options is also understood to fall within the meaning, and, therefore, satisfy the requirement of the term "and/or."

When a list is presented, unless stated otherwise, it is to be understood that each individual element of that list, and every combination of that list, is a separate embodiment. For example, a list of embodiments presented as "A, B, or C" is to be interpreted as including the embodiments, "A," "B," "C," "A or B," "A or C," "B or C," or "A, B, or C."

As used herein, an "antigen" is a substance that can be recognized by an antibody, B cell or T cell. As used herein, the term "tumor associated antigen" or "TAA" refers to a protein or polypeptide antigen that is expressed by a cancer cell (e.g., a tumor cell). For example, a TAA may be one or more surface proteins or polypeptides, nuclear proteins or glycoproteins, or fragments thereof, of a cancer cell (e.g., a tumor cell). Examples of TAAs include, but are not limited to, colon cancer antigen 19.9; a gastric cancer mucin; antigen 4.2; glycoprotein A33 (gpA33); ADAM-9; gastric cancer antigen AH6; ALCAM; malignant human lymphocyte antigen APO-1; cancer antigen B1; B7 H3; beta-catenin; blood group ALeb/Ley; Burkitt's lymphoma antigen-38.13, colonic adenocarcinoma antigen C14; ovarian carcinoma antigen CA125; Carboxypeptidase M; CD5; CD19; CD20; CD22; CD23; CD25; CD27; CD30; CD33; CD36; CD45; CD46; CD52; CD79a/CD79b; CD103; CD317; CDK4; carcinoembryonic antigen (CEA); CEACAM5; CEACAM6; C017-iA; CO-43 (blood group Leb); CO-514 (blood group Lea); CTA-1; CTLA4; Cytokeratin 8; antigen D1.1; antigen D 156-22; DR5; Ei series (blood group B); EGFR (Epidermal Growth Factor Receptor); Ephrin receptor A2 (EphA2); ErbB1; ErbB3; ErbB4; GAGE-1; GAGE-2; GD2/GD3/GM2; lung adenocarcinoma antigen F3; antigen FC10.2; G49, ganglioside GD2; ganglioside GD3; ganglioside GM2; ganglioside GM3; GD2; GD3; GICA 19-9; GM2; gpOO; glypican-3 (GPC3); human leukemia T cell antigen Gp37; melanoma antigen gp75; gpA33; HER2 antigen (e.g., pi85 HER2); human milk fat globule antigen (HMFG); human papillomavirus E6/human papillomavirus-E7; high molecular weight melanoma antigen (HMW MAA); I antigen (differentiation antigen) I(Ma); Integrin Alpha-V-Beta-6 IntegrinP6 (ITGB6); Interleukin-13; Receptor a2 (IL13Rα2); JAM-3; KID3; KID31; KS 1/4 pan carcinoma antigen; human lung carcinoma antigens L6 and L20; LEA; LUCA-2; Mi:22:25:8; M18; M39; MAGE-1; MAGE-3; MART; MUC-1; MUM-1; Myl; N acetylglu-cosaminyltransferase; neoglycoprotein; NS-10; OFA-1; OFA-2; Oncostatin M; p15; melanoma-associated antigen p97; polymorphic epithelial mucin (PEM); polymorphic epithelial mucin antigen (PEMA); PIPA; prostate-specific antigen (PSA); prostate-specific membrane antigen (PSMA); prostatic acid phosphate; R2 4; RORi; sphingolipids; SSEA-1; SSEA-3; SSEA-4; sTn; T cell receptor derived peptide; T 5A7; TAG-72; TL5 (blood group A); TNF-α receptor; TNF-β receptor; TNF-γ receptor; TRA-1-85 (blood group H); Transferrin Receptor; tumor-specific transplantation antigen (TSTA), oncofetal antigen-alpha-fetoprotein (AFP); VEGF; VEGFR, VEP8; VEP9; VIM-D5; and Y hapten, Ley. In some embodiments, TAA is CEA, GPC3, MUC-1, EpCAM, HER receptors, PEM, Caludi 6, Cluadi-18.2, mesothelin, A33, G250, carbohydrate antigens Ley, Lex, Leb, PSMA, TAG-72, STEAP1, CD166, CD24, CD44, E-cadherin, SPARC, ErbB2, ErbB3, MUC1, LMP2, idiotype, HPV E6&E7, EGFR, EGFRvIII, HER-2/neu, MAGE A3, NY-ESO-1, GD2, PSMA, PCSA, PSA, MelanA/MART1, CD19, CD20, CD22, CD33, CD5, CD70, or BCMA. In some embodiments, the TAA is on a cancer cell that is not a tumor cell. In other embodiments, the TAA is on a tumor cell.

The definitions of protein, peptide and polypeptide are well-known in the art. The term "protein", as used herein, is synonymous with the term "peptide" or "polypeptide," and is understood to mean a chain of amino acids arranged linearly and joined together by peptide bonds between the carboxyl and amino groups of adjacent amino acid residues. Thus, the term polypeptide can refer to a full-length amino acid sequence of a protein, or to a fragment thereof.

As used herein, the term "T-cell engager" or "TE" refers to a molecule (e.g., an antibody) that is capable of binding to an epitope, including one, two, or more epitopes. In many embodiments, the T-cell engager is capable of binding to a surface antigen on T-cell and a TAA. In some embodiments, the T-cell engager is capable of binding to a surface antigen on T-cell and at least two TAA epitopes. In certain embodiments, the at least two epitopes are on a TAA. In some embodiments, the T-cell engager is capable of binding to a surface antigen on T-cell and at least two TAAs. Without being limited by the following, examples of a surface antigen on T-cell can include CD2, CD3, VLA-1, CD8, CD4, CCR6, CXCR5, CD25, CD31, CD45RO, CD197, CD127, CD38, CD27, CD196, CD277, or CXCR3. In many instances, the term "BiTE," "T-cell engager," and "TE" can be used interchangeably.

As used herein, the term "conservative amino acid substitution(s)" or "conservative substitution(s)" refers to an amino acid substitution having a value of 0 or greater in BLOSUM62.

As used herein, the term "highly conservative amino acid substitution(s)" or "highly conservative substitution(s)" refers to an amino acid substitution having a value of at least 1 (e.g., at least 2) in BLOSUM62.

As used herein, the term "expression vector" refers to a replicable nucleic acid from which one or more proteins can be expressed when the expression vector is transformed into a suitable expression host cell. As used herein, the term "promoter" refers to a region of DNA to which RNA polymerase binds and initiates the transcription of a gene. As used herein, the term "operably linked" means that the nucleic acid is positioned in the recombinant polynucleotide, e.g., vector, in such a way that enables expression of the nucleic acid under control of the element (e.g., promoter) to which it is linked. As used herein, the term "selectable marker element" is an element that confers a trait suitable for artificial selection. Selectable marker elements can be negative or positive selection markers.

As used herein, the term "ex vivo" refers to methods conducted within or on cells or tissue in an artificial environment outside an organism with minimum alteration of natural conditions. As used herein, the term "in vivo" refers to a method that is conducted within living organisms in their normal, intact state. As used herein, the term "in vitro" method is conducted using components of an organism that have been isolated from its usual biological context.

As used herein, the term "fusion protein" refers to a synthetic, semi-synthetic or recombinant single protein molecule. A fusion protein can comprise all or a portion of two or more different proteins and/or polypeptides that are attached by covalent bonds (e.g., peptide bonds).

As used herein, the term "sequence identity" refers to the extent to which two nucleotide sequences, or two amino acid sequences, have the same residues at the same positions when the sequences are aligned to achieve a maximal level of identity, expressed as a percentage. For sequence alignment and comparison, typically one sequence is designated as a reference sequence, to which a test sequences are compared. The sequence identity between reference and test sequences is expressed as the percentage of positions across the entire length of the reference sequence where the reference and test sequences share the same nucleotide or amino acid upon alignment of the reference and test sequences to achieve a maximal level of identity. As an example, two sequences are considered to have 70% sequence identity when, upon alignment to achieve a maximal level of identity, the test sequence has the same nucleotide or amino acid residue at 70% of the same positions over the entire length of the reference sequence.

Alignment of sequences for comparison to achieve maximal levels of identity can be readily performed by a person of ordinary skill in the art using an appropriate alignment method or algorithm. In some instances, the alignment can include introduced gaps to provide for the maximal level of identity. Examples include the local homology algorithm of Smith & Waterman, *Adv. Appl. Math.* 2:482 (1981), the homology alignment algorithm of Needleman & Wunsch, *J. Mol. Biol.* 48:443 (1970), the search for similarity method of Pearson & Lipman, *Proc. Nat'l. Acad. Sci. USA* 85:2444 (1988), computerized implementations of these algorithms (GAP, BESTFIT, FASTA, and TFASTA in the Wisconsin Genetics Software Package, Genetics Computer Group, 575 Science Dr., Madison, Wis.), and visual inspection (see generally Ausubel et al., Current Protocols in Molecular Biology).

When using a sequence comparison algorithm, test and reference sequences are input into a computer, subsequent coordinates are designated, if necessary, and sequence algorithm program parameters are designated. The sequence comparison algorithm then calculates the percent sequence identity for the test sequence(s) relative to the reference sequence, based on the designated program parameters. A commonly used tool for determining percent sequence identity is Protein Basic Local Alignment Search Tool (BLASTP) available through National Center for Biotechnology Information, National Library of Medicine, of the United States National Institutes of Health. (Altschul et al., 1990).

As used herein, the term "subject" or "patient" refers to a mammal (e.g., a human). In some embodiments, the subject is a mammal. In some embodiments, the subject is a mammal selected from a dog, a cat, a mouse, a rat, a hamster, a guinea pig, a horse, a pig, a sheep, a cow, a chimpanzee, a macaque, a cynomolgus, and a human. In some embodiments, the subject is a primate. In some embodiments, the subject is a human.

As used herein, the term "a therapeutically effective amount," "an effective amount" or "an effective dosage" is an amount effective, at dosages and for periods of time necessary, to achieve a desired therapeutic result (e.g., treatment, healing, inhibition or amelioration of physiological response or condition, etc.). The full therapeutic effect does not necessarily occur by administration of one dose and may occur only after administration of a series of doses. Thus, a therapeutically effective amount may be administered in one or more administrations. A therapeutically effective amount may vary according to factors such as disease state, age, sex, and weight of a mammal, mode of administration and the ability of a therapeutic, or combination of therapeutics, to elicit a desired response in an individual.

An effective amount of an agent to be administered can be determined by a clinician of ordinary skill using the guidance provided herein and other methods known in the art. Relevant factors include the given agent, the pharmaceutical formulation, the route of administration, the type of disease or disorder, the identity of the subject (e.g., age, sex, weight) or host being treated, and the like. For example, suitable dosages can be from about 0.001 mg/kg to about 100 mg/kg, from about 0.01 mg/kg to about 100 mg/kg, from about 0.01 mg/kg to about 10 mg/kg, from about 0.01 mg/kg to about 1 mg/kg body weight per treatment. Determining the dosage for a particular agent, subject and disease is well within the abilities of one of skill in the art. Preferably, the dosage does not cause or produces minimal adverse side effects.

Desired response or desired results include effects at the cellular level, tissue level, or clinical results. As such, "a therapeutically effective amount" or synonym thereto depends upon the context in which it is being applied. For example, in some embodiments it is an amount of the composition sufficient to achieve a treatment response as compared to the response obtained without administration of the composition. In other embodiments, it is an amount that results in a beneficial or desired result in a subject as compared to a control. As defined herein, a therapeutically effective amount of a composition of the present disclosure may be readily determined by one of ordinary skill by routine methods known in the art. Dosage regimen and route of administration may be adjusted to provide the optimum therapeutic response.

As used herein, the term "treating," or its equivalents (e.g., "treatment" or "treat"), refers to the medical management of a subject with the intent to improve, ameliorate, stabilize (i.e., not worsen), prevent or cure a disease, pathological condition, or disorder-such as the particular indications exemplified herein. This term includes active treatment (treatment directed to improve the disease, pathological condition, or disorder), causal treatment (treatment directed to the cause of the associated disease, pathological condition, or disorder), palliative treatment (treatment designed for the relief of symptoms), preventative treatment (treatment directed to minimizing or partially or completely inhibiting the development of the associated disease, pathological condition, or disorder); and supportive treatment (treatment employed to supplement another therapy). Treatment also includes diminishment of the extent of the disease or condition; preventing spread of the disease or condition; delay or slowing the progress of the disease or condition; amelioration or palliation of the disease or condition; and remission (whether partial or total), whether detectable or undetectable. "Treatment" can also mean prolonging survival as compared to expected survival if not receiving treatment. Those in need of treatment include those already with the condition or disorder, as well as those prone to have the condition or disorder or those in which the condition or disorder is to be prevented.

As used herein, the term "ameliorating" or "palliating" a disease or condition means that the extent and/or undesirable clinical manifestations of the disease, disorder, or condition are lessened and/or time course of the progression is slowed or lengthened, as compared to the extent or time course in the absence of treatment.

As used herein, a "vector" refers to a nucleic acid molecule which may be employed to introduce a nucleic acid sequence or gene into a cell, either in vitro, ex vivo, or in vivo.

The present disclosure further provides the following numbered embodiments:

Embodiment 1 is a T lymphocyte, comprising:
a) a polynucleotide comprising a sequence encoding a bi-specific chimeric antigen receptor (CAR) that is capable of binding to human epidermal growth factor receptor 2 (HER2) and IL13Rα2, and a polynucleotide comprising a sequence encoding a BiTE that is capable of binding to CD3 and a TAA; or
b) a polynucleotide comprising a sequence encoding a fusion protein of a bi-specific CAR that is capable of binding to HER2 and IL13Rα2, and a BiTE that is capable of binding to CD3 and a TAA.

Embodiment 2 is the T lymphocyte of embodiment 1, wherein the T lymphocyte comprises the polynucleotide comprising the sequence encoding the bi-specific CAR and the polynucleotide comprising the sequence encoding the BiTE.

Embodiment 3 is the T lymphocyte of embodiment 1, wherein the T lymphocyte comprises the polynucleotide comprising the sequence encoding the fusion protein of the bi-specific CAR and the BiTE.

Embodiment 4 is the T lymphocyte of any one of embodiments 1-3, wherein the bi-specific CAR comprises an IL13 mutein linked to a HER2-binding single-chain variable fragment (scFv) via a linker sequence.

Embodiment 5 is the T lymphocyte of embodiment 4, wherein the IL13 mutein comprises an amino acid sequence that is at least 90% identical to the amino acid sequence of SEQ ID NO: 1.

Embodiment 6 is the T lymphocyte of embodiment 4, wherein the IL13 mutein comprises about 1-12 amino acid substitutions, relative to the amino acid sequence of SEQ ID NO: 1.

Embodiment 7 is the T lymphocyte of embodiment 4, wherein the IL13 mutein comprises the amino acid sequence of SEQ ID NO: 1.

Embodiment 8 is the T lymphocyte of any one of embodiments 1-7, wherein the HER2-binding scFv comprises an amino acid sequence that is at least 90% identical to the amino acid sequence of SEQ ID NO: 2, 3 or 4, or a combination thereof.

Embodiment 9 is the T lymphocyte of embodiment 8, wherein the HER2-binding scFv comprises an amino acid sequence that is at least 90% identical to the amino acid sequence of SEQ ID NO: 4.

Embodiment 10 is the T lymphocyte of any one of embodiments 1-7, the HER2-binding scFv comprises about 1-25 amino acid substitutions, relative to the amino acid sequence of SEQ ID NO: 2, 3 or 4, or a combination of thereof.

Embodiment 11 is the T lymphocyte of embodiment 10, wherein the HER2-binding scFv comprises about 1-25 amino acid substitutions, relative to the amino acid sequence of SEQ ID NO: 4.

Embodiment 12 is the T lymphocyte of any one of embodiments 1-7, wherein the HER2-binding scFv comprises the amino acid sequence of SEQ ID NO: 2, 3 or 4.

Embodiment 13 is the T lymphocyte of embodiment 12, wherein the HER2-binding scFv comprises the amino acid sequence of SEQ ID NO: 4.

Embodiment 14 is the T lymphocyte of embodiment 6, 10 or 11, wherein the amino acid substitutions are conservative substitutions.

Embodiment 15 is the T lymphocyte of embodiment 6, 10 or 11, wherein the amino acid substitutions are highly conservative substitutions.

Embodiment 16 is the T lymphocyte of any one of embodiments 1-15, wherein the bi-specific CAR further comprises:
a) a CD8α signal peptide;
b) a CD8α hinge;
c) a CD28 transmembrane domain;
d) a 4-1BB costimulatory domain; or
e) a CD3ζ signaling domain,
or a combination thereof.

Embodiment 17 is the T lymphocyte of embodiment 16, wherein: a) the linker comprises an amino acid sequence that is at least 90% identical to the amino acid sequence of SEQ ID NO: 5;
b) the CD8α signal peptide comprises an amino acid sequence that is at least 90% identical to the amino acid sequence of SEQ ID NO: 6;
c) the CD8α hinge comprises an amino acid sequence that is at least 90% identical to the amino acid sequence of SEQ ID NO: 7;
d) the CD28 transmembrane domain comprises an amino acid sequence that is at least 90% identical to the amino acid sequence of SEQ ID NO: 8;
e) the 4-1BB costimulatory domain comprises an amino acid sequence that is at least 90% identical to the amino acid sequence of SEQ ID NO: 9; or f) the CD3ζ signaling domain comprises an amino acid sequence that is at least 90% identical to the amino acid sequence of SEQ ID NO: 10,
or a combination thereof.

Embodiment 18 is the T lymphocyte of embodiment 16, wherein: a) the linker comprises about 1 or 2 amino acid substitutions, relative to the amino acid sequence of SEQ ID NO: 5;
b) the CD8α signal peptide comprises about 1 or 2 amino acid substitutions, relative to the amino acid sequence of SEQ ID NO: 6;
c) the CD8α hinge comprises about 1-5 amino acid substitutions, relative to the amino acid sequence of SEQ ID NO: 7;
d) the CD28 transmembrane domain comprises about 1-3 amino acid substitutions, relative to the amino acid sequence of SEQ ID NO: 8;
e) the 4-1BB costimulatory domain comprises about 1-5 amino acid substitutions, relative to the amino acid sequence of SEQ ID NO: 9; or
f) the CD3ζ signaling domain comprises about 1-12 amino acid substitutions, relative to the amino acid sequence of SEQ ID NO: 10, or
a combination thereof.

Embodiment 19 is the T lymphocyte of embodiment 16, wherein:
a) the linker comprises the amino acid sequence of SEQ ID NO: 5;
b) the CD8α signal peptide comprises the amino acid sequence of SEQ ID NO: 6;
c) the CD8α hinge comprises the amino acid sequence of SEQ ID NO: 7;
d) the CD28 transmembrane domain comprises the amino acid sequence of SEQ ID NO: 8;
e) the 4-1BB costimulatory domain comprises the amino acid sequence of SEQ ID NO: 9; or
f) the CD3ζ signaling domain comprises the amino acid sequence of SEQ ID NO: 10,
or a combination thereof.

Embodiment 20 is the T lymphocyte of any one of embodiments 1-19, wherein the bi-specific CAR comprises an amino acid sequence that is at least 90% identical to the amino acid sequence of SEQ ID NO: 11, 12 or 13 or a combination of thereof.

Embodiment 21 is the T lymphocyte of any one of embodiments 1-19, wherein the bi-specific CAR comprises about 1-60 amino acid substitutions, relative to the amino acid sequence of SEQ ID NO: 11, 12 or 13 or a combination of thereof.

Embodiment 22 is the T lymphocyte of any one of embodiments 1-19, wherein the bi-specific CAR comprises the amino acid sequence of SEQ ID NO: 11, 12 or 13.

Embodiment 23 is the T lymphocyte of any one of embodiments 1-22, wherein the T lymphocyte expresses the bi-specific CAR.

Embodiment 24 is the T lymphocyte of any one of embodiments 1-23, wherein the BiTE comprises a CD3-binding single-chain variable fragment (scFv).

Embodiment 25 is the T lymphocyte of embodiment 24, wherein the CD3-binding scFv comprises an amino acid sequence that is at least 90% identical to the amino acid sequence of SEQ ID NO: 14.

Embodiment 26 is the T lymphocyte of embodiment 24, wherein the CD3-binding scFv comprises about 1-25 amino acid substitutions, relative to the amino acid sequence of SEQ ID NO: 14.

Embodiment 27 is the T lymphocyte of embodiment 24, wherein the CD3-binding scFv comprises the amino acid sequence of SEQ ID NO: 14.

Embodiment 28 is the T lymphocyte of any one of embodiments 1-27, wherein the TAA is an epidermal growth factor receptor (EGFR) antigen.

Embodiment 29 is the T lymphocyte of any one of embodiments 1-27, wherein the TAA is an EGFRvIII antigen.

Embodiment 30 is the T lymphocyte of embodiment 28 or 29, wherein the BiTE comprises:
a) at least one EGFR-binding nanobody linked to the CD3-binding scFv via a linker sequence comprising GGGGS (SEQ ID NO: 18); or
b) at least one EGFRvIII-binding nanobody linked to the CD3-binding scFv via a linker sequence comprising GGGGS (SEQ ID NO: 18).

Embodiment 31 is the T lymphocyte of embodiment 30, wherein the BiTE comprises:
a) at least two EGFR-binding nanobodies;
b) at least two EGFRvIII-binding nanobodies; or
c) at least one EGFR-binding nanobody and at least one EGFRvIII-binding nanobody.

Embodiment 32 is the T lymphocyte of embodiment 30 or 31, wherein:
a) the at least one EGFR-binding nanobody comprises an amino acid sequence that is at least 90% identical to the amino acid sequence of SEQ ID NO: 15, 16 or 17, or a combination of thereof; or
b) the at least one EGFRvIII-binding nanobody comprises an amino acid sequence that is at least 90% identical to the amino acid sequence of SEQ ID NO: 15, 16 or 17, or a combination of thereof.

Embodiment 33 is the T lymphocyte of embodiment 30 or 31, wherein:
a) the at least one EGFR-binding nanobody comprises about 1-12 amino acid substitutions, relative to the amino acid sequence of SEQ ID NO: 15, 16 or 17, or a combination of thereof; or
b) the at least one EGFRvIII-binding nanobody comprises about 1-12 amino acid substitutions, relative to the amino acid sequence of SEQ ID NO: 15, 16 or 17, or a combination of thereof.

Embodiment 34 is the T lymphocyte of embodiment 30 or 31, wherein:
a) the at least one EGFR-binding nanobody comprises the amino acid sequence of SEQ ID NO: 15, 16 or 17; or
b) the at least one EGFRvIII-binding nanobody comprises the amino acid sequence of SEQ ID NO: 15, 16 or 17.

Embodiment 35 is the T lymphocyte of any one of embodiments 29-34, wherein the BiTE further comprises a signal peptide and a 6× His tag sequence (SEQ ID NO: 20).

Embodiment 36 is the T lymphocyte of embodiment 35, wherein the signal peptide comprises an amino acid sequence that is at least 90% identical to the amino acid sequence of SEQ ID NO: 19.

Embodiment 37 is the T lymphocyte of embodiment 35, wherein the signal peptide comprises an amino acid sequence that is at least 90% identical to the amino acid sequence of SEQ ID NO: 19.

Embodiment 38 is the T lymphocyte of embodiment 35, wherein the signal peptide comprises about 1 or 2 amino acid substitutions, relative to the amino acid sequence of SEQ ID NO:19.

Embodiment 39 is the T lymphocyte of embodiment 35, wherein the signal peptide comprises the amino acid sequence of SEQ ID NO:19.

Embodiment 40 is the T lymphocyte of any one of embodiments 29-39, wherein the BiTE comprises an amino acid sequence that is at least 90% identical to the amino acid sequence of SEQ ID NO: 21, 22, 23, 24, 25, 26 or 27.

Embodiment 41 is the T lymphocyte of any one of embodiments 29-39, wherein the BiTE comprises about 1-40 amino acid substitutions, relative to the amino acid sequence of SEQ ID NO: 21, 22 or 23, or a combination of thereof.

Embodiment 42 is the T lymphocyte of any one of embodiments 29-39, wherein the BiTE comprises about 1-55 amino acid substitutions, relative to the amino acid sequence of SEQ ID NO: 24, 25, 26 or 27, or a combination of thereof.

Embodiment 43 is the T lymphocyte of any one of embodiments 29-39, wherein the BiTE comprises the amino acid sequence of SEQ ID NO: 21, 22, 23, 24, 25, 26 or 27.

Embodiment 44 is the T lymphocyte of embodiment 29, wherein the BiTE comprises:
  a) an EGFR antibody linked to the CD3-binding scFv via a linker sequence comprising GGGGS (SEQ ID NO: 16); or
  b) an EGFRvIII antibody linked to the CD3-binding scFv via a linker sequence comprising GGGGS (SEQ ID NO: 16).

Embodiment 45 is the T lymphocyte of embodiment 44, wherein:
  a) the EGFR antibody comprises an amino acid sequence that is at least 90% identical to the amino acid sequence of SEQ ID NO: 29; or
  b) the EGFRvIII antibody comprises an amino acid sequence that is at least 90% identical to the amino acid sequence of SEQ ID NO: 29.

Embodiment 46 is the T lymphocyte of embodiment 44, wherein:
  a) the EGFR antibody comprises about 1-25 amino acid substitutions, relative to the amino acid sequence of SEQ ID NO: 29; or
  b) the EGFRvIII antibody comprises about 1-25 amino acid substitutions, relative to the amino acid sequence of SEQ ID NO: 29.

Embodiment 47 is the T lymphocyte of embodiment 44, wherein:
  a) the EGFR antibody comprises the amino acid sequence of SEQ ID NO: 29; or
  b) the EGFRvIII antibody comprises the amino acid sequence of SEQ ID NO: 29.

Embodiment 48 is the T lymphocyte of any one of embodiments 1-47, wherein the T lymphocyte secretes the BiTE.

Embodiment 49 is the T lymphocyte of any one of embodiments 3-48, wherein the fusion protein further comprises a self-cleaving T2A Peptide (SEQ ID NO: 28).

Embodiment 50 is the T lymphocyte of any one of embodiments 3-49, wherein the fusion protein comprises an amino acid sequence that is at least 90% identical to the amino acid sequence of SEQ ID NO: 31, 32, 33, 34, 35, 36, 37 or 38, or a combination of thereof.

Embodiment 51 is the T lymphocyte of any one of embodiments 3-49, wherein the fusion protein comprises about 1-100 amino acid substitutions, relative to the amino acid sequence of SEQ ID NO: 31, 32, 33, 34, 35, 36, 37 or 38, or a combination of thereof.

Embodiment 52 is the T lymphocyte of embodiment 51, wherein the fusion protein comprises about 1-100 amino acid substitutions, relative to the amino acid sequence of SEQ ID NO: 37.

Embodiment 53 is the T lymphocyte of any one of embodiments 3-49, wherein the fusion protein comprises the amino acid sequence of SEQ ID NO: 31, 32, 33, 34, 35, 36, 37 or 38.

Embodiment 54 is the T lymphocyte of embodiment 53, wherein the fusion protein comprises the amino acid sequence of SEQ ID NO: 37.

Embodiment 55 is a fusion protein of a bi-specific chimeric antigen receptor (CAR) that is capable of binding to HER2 and IL13Rα2, and a BiTE that is capable of binding to CD3 and a TAA.

Embodiment 56 is a polynucleotide comprising a sequence encoding the fusion protein of embodiment 55.

Embodiment 57 is an expression vector comprising the polynucleotide of embodiment 56.

Embodiment 58 is a host cell comprising the polynucleotide of embodiment 51 or the expression vector of embodiment 57.

Embodiment 59 is a composition comprising T lymphocytes, wherein at least a portion of the T lymphocytes comprise:
  a) a polynucleotide comprising a sequence encoding a bi-specific chimeric antigen receptor (CAR) that is capable of binding to HER2 and IL13Rα2, and a polynucleotide comprising a sequence encoding a BiTE that is capable of binding to CD3 and a TAA; or
  b) a polynucleotide comprising a sequence encoding a fusion protein of a bi-specific CAR that is capable of binding to HER2 and IL13Rα2, and a BiTE that is capable of binding to CD3 and a TAA.

Embodiment 60 is the composition of embodiment 59, further comprising a cryopreservation medium comprising about 2%, about 5%, or about 10% dimethyl sulfoxide (DMSO) and substantially free of serum.

Embodiment 61 is the composition of embodiment 59 or 60 in a storage vial.

Embodiment 62 is a pharmaceutical composition comprising the composition of embodiment 59 or 60 and a pharmaceutically acceptable carrier.

Embodiment 63 is a kit comprising a container and optionally an instruction for use, wherein the container comprises the pharmaceutical composition of embodiment 62.

Embodiment 64 is use of a composition of embodiment 59 or 60 or the pharmaceutical composition of embodiment 57, for the preparation of a medicament for treating glioblastoma in a subject in need thereof.

Embodiment 65 is a method of treating cancer in a subject in need thereof, comprising administering to the subject an effective dosage of T lymphocytes, wherein at least a portion of the T lymphocytes comprise:
  a) a polynucleotide comprising a sequence encoding a bi-specific chimeric antigen receptor (CAR) that is capable of binding to HER2 and IL13Rα2, and a polynucleotide comprising a sequence encoding a BiTE that is capable of binding to CD3 and a TAA; or
  b) a polynucleotide comprising a sequence encoding a fusion protein of a bi-specific CAR that is capable of binding to HER2 and IL13Rα2, and a BiTE that is capable of binding to CD3 and a TAA.

Embodiment 66 is a method of treating glioblastoma in a subject in need thereof, comprising administering to the subject an effective dosage of T lymphocytes, wherein at least a portion of the T lymphocytes comprise:
  a) a polynucleotide comprising a sequence encoding a bi-specific chimeric antigen receptor (CAR) that is capable of binding to HER2 and IL13Rα2, and a polynucleotide comprising a sequence encoding a BiTE that is capable of binding to CD3 and a TAA; or b) a polynucleotide comprising a sequence encoding a fusion protein of a bi-specific CAR that is capable of binding to HER2 and IL13Rα2, and a BiTE that is capable of binding to CD3 and a TAA.

Embodiment 67 is the method of embodiment 65 or 66, wherein the T lymphocytes are allogeneic T lymphocytes.

Embodiment 68 is the method of any one of embodiments 65-67, wherein at least 10% of the T lymphocytes express the bi-specific CAR and the BiTE.

Embodiment 69 is the method of embodiment 68, wherein about 15-75% of the T lymphocytes express the bi-specific CAR and the BiTE.

Embodiment 70 is the method of any one of embodiments 65-69, wherein the T lymphocytes are administered as a single intravenous infusion.

Embodiment 71 is the method of any one of embodiments 65-69, wherein the T lymphocytes are administered as two or more intravenous infusions.

Embodiment 72 is the method of any one of embodiments 65-71, further comprising administering to the subject a chemotherapy before administration of the T lymphocytes.

Embodiment 73 is the method of any one of embodiments 65-72, wherein the subject is 18 years of age or older.

Embodiment 74 is the method of any one of embodiments 65-73, wherein the subject is newly diagnosed with glioblastoma.

Embodiment 75 is the method of any one of embodiments 65-73, wherein the subject has relapsed from or is refractory to a prior glioblastoma therapy.

Embodiment 76 is the method of any one of embodiments 65-75, wherein the subject is a human patient.

Embodiment 77 is a method of inducing T cell-mediated cytolysis of cancer cells, comprising contacting the cancer cells with an effective dosage of T lymphocytes, wherein at least a portion of the T lymphocytes comprise:

a) a polynucleotide comprising a sequence encoding a bi-specific chimeric antigen receptor (CAR) that is capable of binding to HER2 and IL13Rα2, and a polynucleotide comprising a sequence encoding a BiTE that is capable of binding to CD3 and a TAA; or b) a polynucleotide comprising a sequence encoding a fusion protein of a bi-specific CAR that is capable of binding to HER2 and IL13Rα2, and a BiTE that is capable of binding to CD3 and a TAA.

Embodiment 78 is a method of inducing T cell-mediated cytolysis of glioblastoma cells, comprising contacting the glioblastoma cells with an effective dosage of T lymphocytes, wherein at least a portion of the T lymphocytes comprise:

a) a polynucleotide comprising a sequence encoding a bi-specific chimeric antigen receptor (CAR) that is capable of binding to HER2 and IL13Rα2, and a polynucleotide comprising a sequence encoding a BiTE that is capable of binding to CD3 and a TAA; or b) a polynucleotide comprising a sequence encoding a fusion protein of a bi-specific CAR that is capable of binding to HER2 and IL13Rα2, and a BiTE that is capable of binding to CD3 and a TAA.

Embodiment 79 is the method of embodiment 78, wherein the glioblastoma cells are in a subject, and contacting the glioblastoma cells with an effective dosage of T lymphocytes is performed by administering to the subject the effective dosage of T lymphocytes.

Embodiment 80 is a T lymphocyte, comprising a polynucleotide comprising a sequence encoding a fusion protein of a bi-specific CAR that is capable of binding to two different antigens expressed on the surface of a cancer cell, and a BiTE that is capable of binding to CD3 and a TAA.

Embodiment 81 is a fusion protein, comprising a bi-specific chimeric antigen receptor (CAR) that is capable of binding to two different antigens expressed on the surface of a cancer cell and a BiTE that is capable of binding to CD3 and a TAA.

Embodiment 82 is a polynucleotide comprising a sequence encoding the fusion protein of embodiment 81.

Embodiment 83 is an expression vector comprising the polynucleotide of embodiment 82.

Embodiment 84 is a host cell comprising the polynucleotide of embodiment 82 or the expression vector of embodiment 83.

Embodiment 85 is a composition comprising T lymphocytes, wherein at least a portion of the T lymphocytes comprise a polynucleotide comprising a sequence encoding a fusion protein of a bi-specific chimeric antigen receptor (CAR) that is capable of binding to two different antigens expressed on the surface of a cancer cell and a BiTE that is capable of binding to CD3 and a TAA.

Embodiment 86 is a pharmaceutical composition comprising the composition of embodiment 85 and a pharmaceutically acceptable carrier.

Embodiment 87 is a kit comprising a container and optionally an instruction for use, wherein the container comprises the pharmaceutical composition of embodiment 86.

Embodiment 88 is use of a composition of embodiment 85 or the pharmaceutical composition of embodiment 86, for the preparation of a medicament for treating tumor in a subject in need thereof.

Embodiment 89 is a method of treating a tumor in a subject in need thereof, comprising administering to the subject an effective dosage of T lymphocytes, wherein at least a portion of the T lymphocytes comprise a polynucleotide comprising a sequence encoding a fusion protein of a bi-specific CAR that is capable of binding to two different antigens expressed on the surface of a cancer cell and a BiTE that is capable of binding to CD3 and a TAA.

Embodiment 90 is a method of inducing T cell-mediated cytolysis of tumor cells, comprising contacting the tumor cells with an effective dosage of T lymphocytes, wherein at least a portion of the T lymphocytes comprise a polynucleotide comprising a sequence encoding a fusion protein of a bi-specific CAR that is capable of binding to two different antigens expressed on the surface of a cancer cell and a BiTE that is capable of binding to CD3 and a TAA.

Embodiment 91 is the T lymphocyte of embodiment 80, the fusion protein of embodiment 81, the polynucleotide of embodiment 82, the expression vector of embodiment 83, the host cell of embodiment 84, the composition of embodiment 85, the pharmaceutical composition of embodiment 86, the kit of embodiment 87, the use of embodiment 88, or the method of embodiment 89 or 90, wherein the tumor is a hematologic tumor.

Embodiment 92 is the T lymphocyte, fusion protein, polynucleotide, expression vector, host cell, composition, pharmaceutical composition, kit, use, or method of embodiment 91, wherein the bi-specific CAR targets CD19, CD20, CD22, CD30, CD33, CD123, CD138, BCMA, or a combination thereof.

Embodiment 93 is the T lymphocyte of embodiment 80, the fusion protein of embodiment 81, the polynucleotide of embodiment 82, the expression vector of embodiment 83, the host cell of embodiment 84, the composition of embodiment 85, the pharmaceutical composition of embodiment 86, the kit of embodiment 87, the use of embodiment 88, or the method of embodiment 89 or 90, wherein the tumor is a solid tumor.

Embodiment 94 is the T lymphocyte, fusion protein, polynucleotide, expression vector, host cell, composition, pharmaceutical composition, kit, use or method of embodiment 93, wherein the tumor is glioblastoma, breast cancer, or lung cancer.

Embodiment 95 is the T lymphocyte, fusion protein, polynucleotide, expression vector, host cell, composition, pharmaceutical composition, kit, use or method of embodiment 94, wherein the breast cancer is HER2-positive breast cancer.

Embodiment 96 is the T lymphocyte, fusion protein, polynucleotide, expression vector, host cell, composition, pharmaceutical composition, kit, use or method of embodiment 94, wherein the lung cancer is brain metastatic lung cancer.

EXAMPLES

Example 1. Material and Methods

Materials used in the Examples are summarized in Table 5.

Virus Generation

A polynucleotide comprising the MNDU3 promoter and the CAR and BiTE sequences separated by the viral T2A sequence, was synthesized by GENEWIZ, Inc., Cambridge, Mass.). The entire polynucleotide sequence was cloned into the lentiviral vector SBILVTV (a third generation, in-house lentiviral transfer vector synthesized by GENEWIZ, Inc., Cambridge, Mass.). Replication-incompetent lentiviruses were produced by co-transfecting the CAR vectors and packaging vectors, SBILVPK1, SBILVPK2 and SBILVPK3 (third generation, in-house lentiviral packaging vectors synthesized by GENEWIZ, Inc.), into HEK293T cells using the TransIT-VirusGEN® Transfection Reagent (Mirus Bio, Madison, Wis., Cat #MIR 6700) following manufacturer's protocol. The viral supernatants were harvested 48 hours after transfection, filtered through a 0.45 µm filter (EMD Millipore, Burlington, Mass., Cat #SE1M003M00), and concentrated by centrifugation at 4° C., 10,000×g for 4 hours. The viral pellet was resuspended in 1.0 mL of 1× Phosphate-buffered saline (PBS), aliquoted, and stored at −80° C.

CAR-T Cell Generation

Human Pan T-cells were isolated from fresh peripheral blood leukopaks obtained from consenting healthy blood donors (HemaCare, Los Angeles, Calif.) by negative selection using the EasySep Human T cells isolation kit (STEMCELL Technologies, Vancouver, BC, Canada, Cat #17951). Pan T-cells were activated with anti-CD3/CD28 beads at a 1:1 ratio (Dynabeads, Gibco; Thermo Fisher Scientific, Inc., Waltham, Cat #11132D) in a 12-well plate with 300 U/mL IL-2 (PeproTech, Inc., Rocky Hill, N.J., Cat #200-02). Twenty-four hours after activation, T cells were transduced with the lentivirus. CAR T-cell cultures were expanded in fresh X-VIVO™ 15 media (Lonza Group, Basel, Switzerland, Cat #BE02-053Q) supplemented with 300 U/mL IL-2 using G-Rex plates for 8 days. On day 8 post-transduction, CAR expression was analyzed using flow cytometry and CAR T cells were collected and resuspended in cryopreservation medium (CryoStor® CS10, STEMCELL technologies, Vancouver, BC, Canada, Cat #7930), aliquoted and stored in liquid nitrogen.

Cytotoxicity Assays

Luciferase-expressing GBM cells, at a concentration of 20,000 cells/well, were plated in 96-well plates. On the following day, effector CAR T cells were added at an effector-to-target (E:T) ratio of 1:1, 0.5:1, 0.25:1, or 0.125:1, or BiTE collected from supernatant of CAR T-cells were co-added with untransduced T-cells (UN) at E:T ratio of 1:1 or 0.5:1. Plates were incubated at 37° C. for 24 hours. Subsequently, D-firefly luciferin potassium salt (PerkinElmer, Inc., Waltham, Mass., Cat #122799) was added to the wells, and luminescence was measured with a microplate reader (Molecular Devices LLC, San Jose, Calif.). Target cells incubated without effector cells or BiTE were used to measure spontaneous death and set the baseline measurement.

For real-time cytotoxicity assays, GBM cell lines were plated at 20,000 cells/well in RTCA plates (ACEA Biosciences, San Diego, Calif., Cat #6472451001). Cell index was recorded as a measure of cell impedance using the xCELLigence RTCA SP instrument (ACEA Biosciences, San Diego, Calif.). On the following day, effector CAR T cells were added at an E:T ratio of 1:1, 0.5:1, 0.25:1, or 0.125:1 or BiTE collected from supernatant of the CAR T cells and UN T cells were added at E:T ratio of 1:1 or 0.5:1. Plates were docked in the RTCA instrument and incubated at 37° C. for a period of 1-5 days.

T-Cell Activation and Functional Assays

GBM cells at a concentration of 20,000 cells/well were plated in 96-well plates. On the next day, Jurkat (NFAT-Luciferase) reporter cells (BPS Bioscience, Inc., San Diego, Calif., Cat #60621) as well as BiTE collected from CAR T-cells supernatant were added at an E:T ratio of 1:1 or 0.5:1. After 24 hours, luciferase activity was assessed using the ONE-Step™ Luciferase assay system (BPS Bioscience, Inc., San Diego, Calif., Cat #60690-1) and luminescence was measured in a microplate reader (Molecular Devices LLC, San Jose, Calif.).

For cytokine release analysis, supernatants from effector cells or BiTE/UN T-cells cocultured with GBM cell lines were analyzed for IL2 cytokine expression (R&D Systems, Minneapolis, Minn., Cat #D2050) or IFN-7 (R&D Systems, Minneapolis, Minn., Cat #DIF50) according to manufacturer's protocol.

Flow Cytometry Analysis

To assess cell surface expression of target-associated antigen (TAA) in GBM cell lines, the following antibody clones were used: anti-EGFR (BV711 anti-human EGFR, BioLegend, San Diego, Calif., Cat #352919), anti-Her2 (BV421 anti-human CD340, BioLegend, San Diego, Calif., Cat #324420), anti-IL13R2a (APC anti-human CD213a2, BioLegend, San Diego, Calif., Cat #354405). For T cells, the following antibodies were used: BV421 anti-human CD3 Antibody (BioLegend, San Diego, Calif., Cat #317344), APC anti-human CD8 Antibody (BioLegend, San Diego, Calif., Cat #344722), PE anti-human CD4 Antibody (BioLegend, San Diego, Calif., Cat #357404). To assess cell surface CAR expression in T cells, the following antigen was used: FITC-Labeled Human IL-13 R alpha 2 Protein and His Tag (ACROBiosystems, Newark, Del., Cat #IL2-H1F2H3-25ug-290). In brief, cells were washed with 1×PBS supplemented with 1% FBS (Flow Cytometry Staining Buffer (FACS Buffer)) and stained at room temperature for 30 minutes in the dark, followed by washing in FACS buffer before analysis.

Cytotoxicity Assays

For real time cytotoxicity assays, cancer cell lines were plated at 20,000 cells per well in RTCA plates (ACEA Bioscience, San Diego, Calif., #6472451001). Cell index was recorded as a measure of cell impedance using the xCELLigence RTCA SP instrument (ACEA Bioscience, San Diego, Calif.). On the following day, effector CAR T-cells were added at an E:T ratio of 1:1, 1:2, 1:4, 1:8, 1:16, 1:32 or 1:64; or BiTE collected from the supernatant of CAR T-cells or control (UN) T cells were added at an E:T ratio of 1:1 or 1:2. Plates were docked in the RTCA instrument and incubated at 37° C. for 1-5 days.

Intra-Cranial (IC) Tumor Xenograft Injection and Intra-Tumor (INT) CAR-T Cells Infusion Following the IACUC protocol, in both in vivo pharmacological efficacy and toxicology studies, the GBM tumor xenograft was carried out as follows: (1) 10,000 luciferase labeled-U87 cells, in 2 µl, were intra-cranially injected into the right front brain; (2) the injection coordinates were ML (2.0 mm), AP (0.5 mm) and DV (2.5 mm_1 µl, 2.25 mm_1 µl); and (3) the injection rate was 1 µl/minute.

Following the IACUC protocol, in the in vivo pharmacological efficacy, PK/bio-distribution and toxicology studies, 200,000 CAR+ SR26 CAR-T cells, in 3 µl, were infused via IC or INT. The infusion coordinates were ML (2.0 mm), AP (0.5 mm) and DV (2.5 mm_1.5 µl, 2.25 mm_1.5 µl). The injection rate was 1.5 µl/minute.

PK Study

Sample Collection of Mouse Organs

Heart, liver, spleen, lung, kidney, bone marrow, spinal cord, blood and brain of NSG mice were collected in 1×PBS solution. Each sample was obtained from three different mice.

Genomic DNA Extraction

Extraction of genomic DNA was performed using PureLink™ Pro 96 Genomic DNA Purification Kit (Invitrogen, #K182104A). Briefly, three small tissues were cut randomly from each organ and weighed to about 25 mg. Each piece was then processed according to the manufacturer's protocol. The final genomic DNA was quantified by nanodrop.

Primer Design

The sequences of the genes for the CAR and BiTE were used to design primers and dual-labeled probes (5' 6-FAM/ZEN/3' IBFQ) using IDT PrimerQuest Tool. All primers and probes have melting temperatures of between 62° C. and 68° C., and amplicon length ranging of 108-146 bp. All other parameters were kept at the default setting. All primers used in this study are listed in Table 6.

Real-Time Quantitative PCR

The real-time quantitative PCR (qPCR) assays were performed using the QuantStudio™ 7 Pro Real-Time PCR System (Applied Biosystems, #A43183). Amplifications were carried out in 20 µl reactions comprising 5 µl genomic DNA (100 ng), 10 µl 2× PrimerTime Gene expression Master Mix (IDT, #1055772), 2 µl forward primer (10 µM), 2 µl reverse primer (10 µM), 0.5 µl probe (10 µM), and 0.5 µl water (Table 7). PCR reactions include: (1) 95° C. for 3 min; and (2) 45 cycles of 95° C. for 15 s and 60° C. for 60 s (Table 8). Reproducibility was verified by assaying, in triplicate, each sample with one primer set for detecting the CAR region and another primer set for detecting the BiTE region. The PCR efficiency (E) values were calculated from the slope of standard curves using a purified "CAR/BiTE" plasmid. A reference gene (Actb, a mouse housekeeping gene, IDT #Mm.PT.39a.22214843.g) was evaluated with each sample, running together in the same plate with all other primer sets.

Bio-Luminescence Imaging (BLI)

Following the IACUC protocol, mice were anesthetized with 3% isoflurane inhaled with 0.5 liter/minute oxygen. Once anesthetized, mice were administered 0.15 ml of 30 mg/ml luciferin, IP. After waiting for ten minutes, imaging was performed using the Spectral Instruments Imaging Ami to capture dorsal views. After imaging, animals were weighed and monitored for recovery from anesthesia.

Organ Harvesting

Following IACUC protocol, mice were first euthanized in a 2.6-liter gas chamber with $CO_2$ at a flow rate of 30-70% of the chambers volume/min. Maximum blood volume was then collected via terminal cardiac puncture in EDTA tubes. After harvesting the heart, the lung, brain, spleen, spinal cord, liver, bone marrow and kidney were harvested for analysis.

Example 2. Identification of IL13Rα2-HER2 Dual CAR Lead Clones SR7, SR8 and SR9

Figure 3:
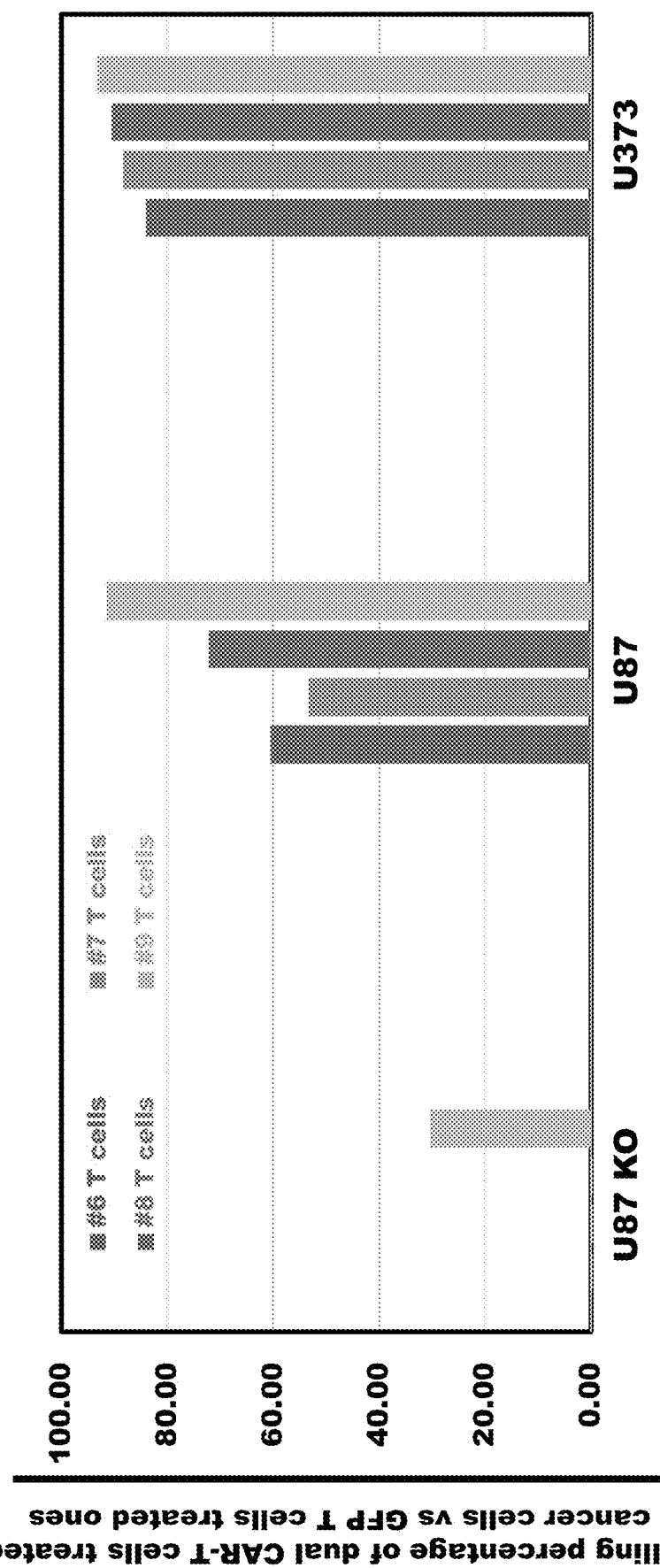
FIG. 3 shows results of luciferase-based killing assay. The data each was collected at 24 hours post CAR-T treatment using the E/T ratio of 0.5 and is the average of the repeating assays (N=6).
Figure 4:
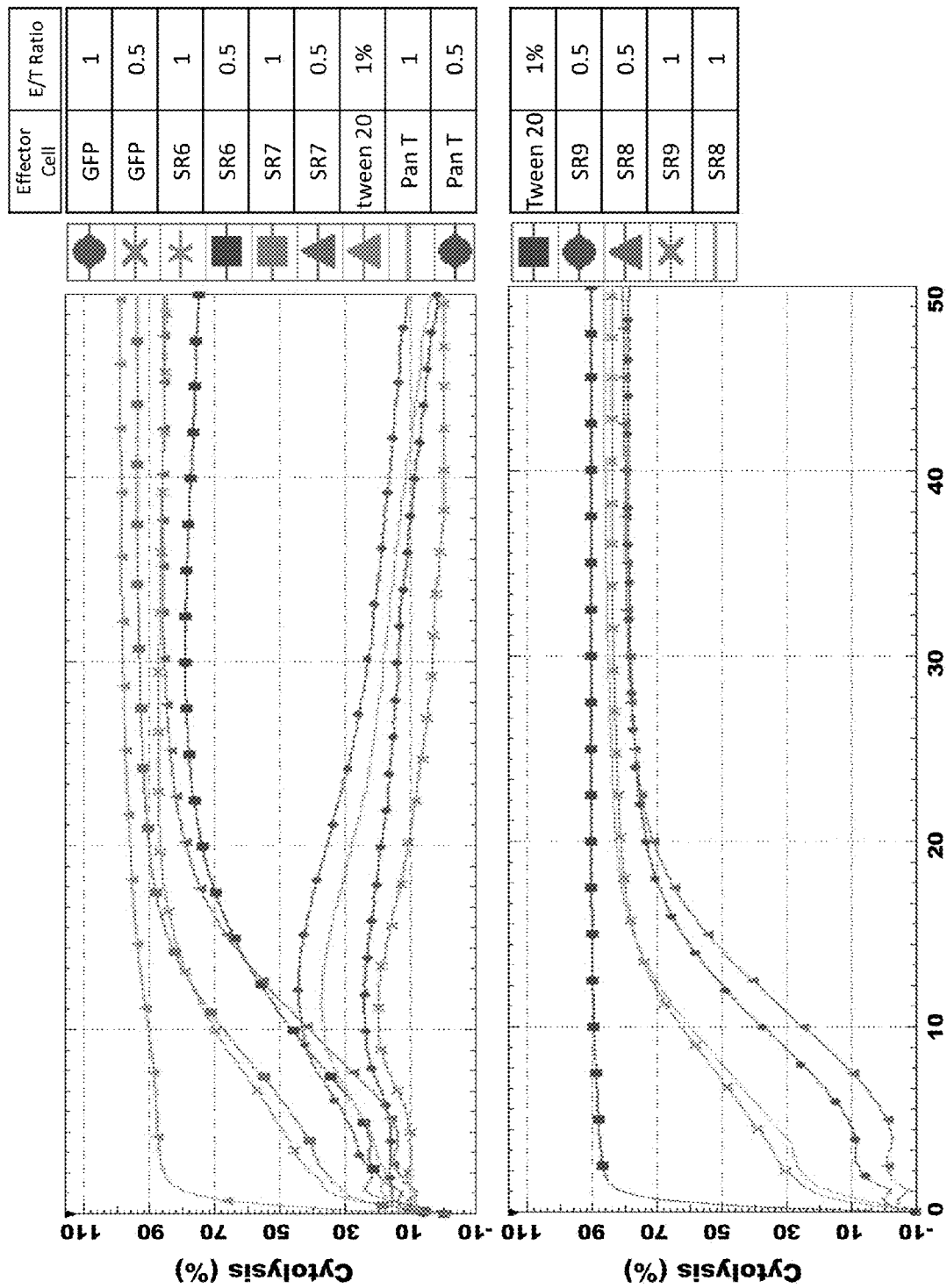
FIG. 4 shows results of RTCA (real time cytolysis assay)-based killing assay. The target cancer cell line is GBM line U373. The data each is the average of the repeating assays (N=3). This set of data is representative of three donors' CAR-T cells treatment results.
Figure 5:
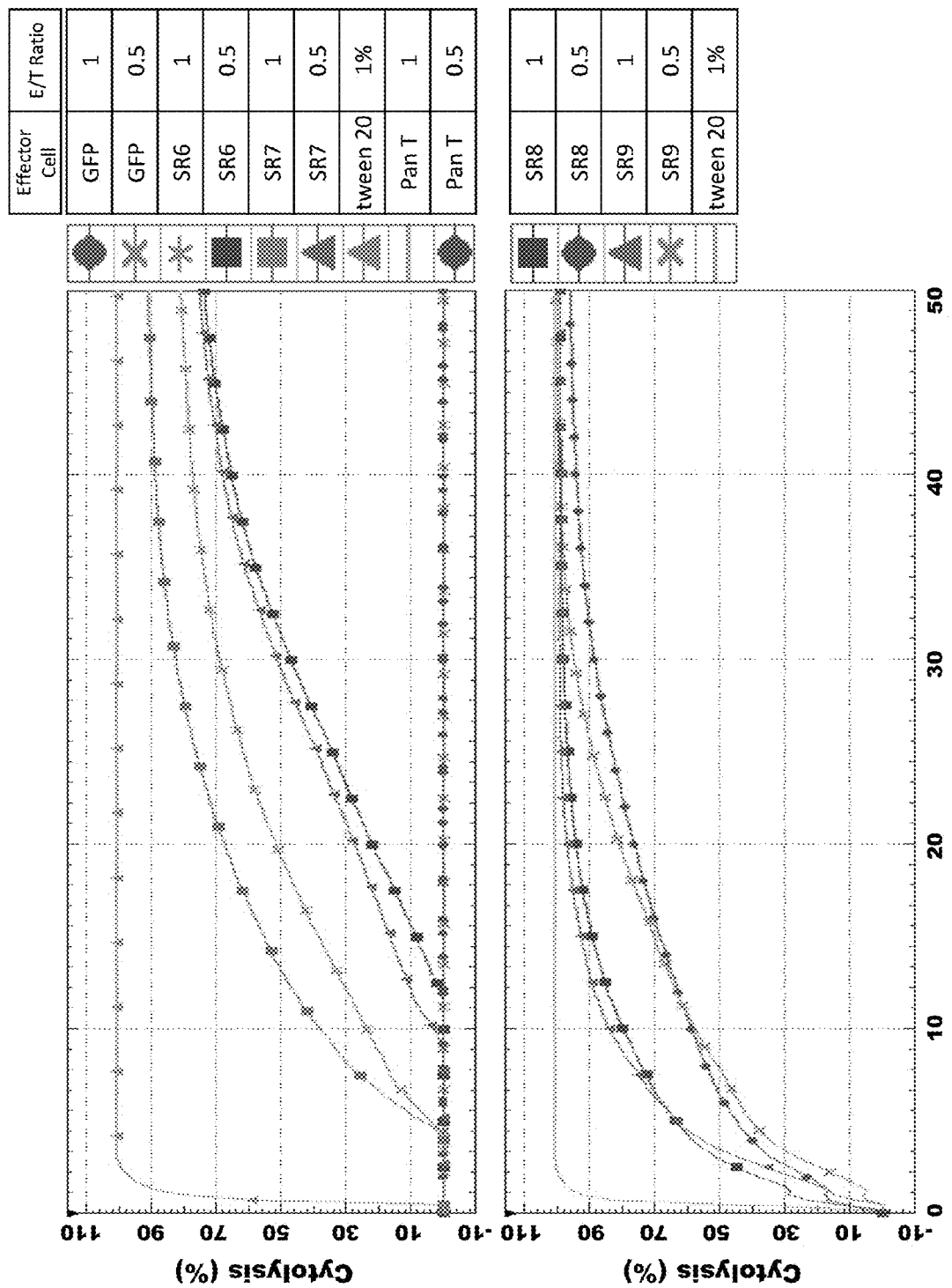
FIG. 5 shows results of RTCA-based killing assay. The target cancer cell line is GBM line T98G. The data each is the average of the repeating assays (N=3). This set of data is representative of three donors' CAR-T cells treatment results.

Before the dual CAR was constructed, the single CARs that is capable of binding to IL13Rα2 and HER2 were constructed and screened using CAR-T cytolysis assay. After the lead clones of the single CARs were identified, the dual CARs were constructed as showed in FIG. 1. The lead clones of SR7-9 were identified using luciferase based killing assay and RTCA (real time cytolysis assay) based assay (FIGS. 3-5). The related killing activity scales are listed in Table 9 (based on a normalized luciferase assay or RTCA assay and a killing activity scale value given to each of CARs, BiTEs, or CAR_BiTEs of this disclosure). The details of the cell lines used for the identification of dual CAR lead clones were listed in FIG. 2.

Example 3. Identification of EGFR-BiTE Lead Clones SR10-12 and SR15-18

Figure 7:
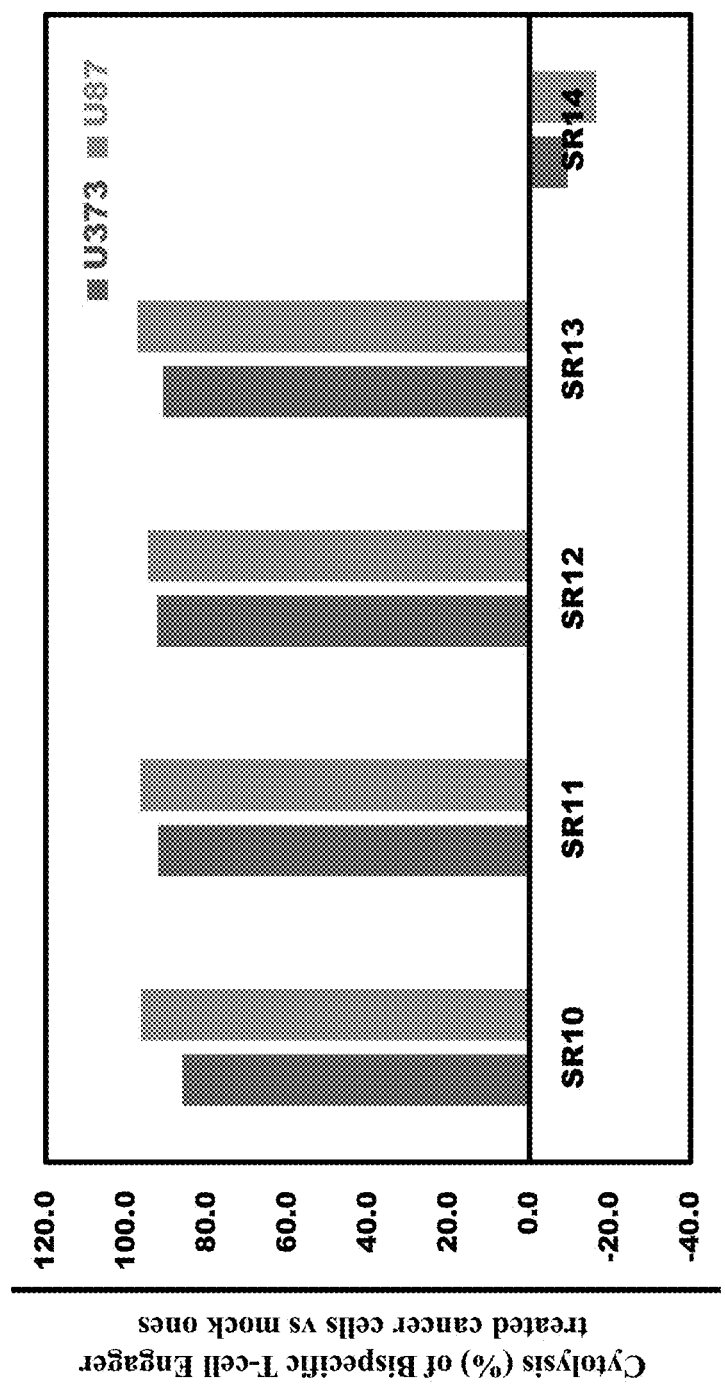
FIG. 7 shows results of luciferase-based killing assay. The data each was collected at 24 hours post BiTE treatment using the E/T ratio of 1 and is the average of the repeating assays (N=6; BiTE concentration: 5 ng/ml).
Figure 8:
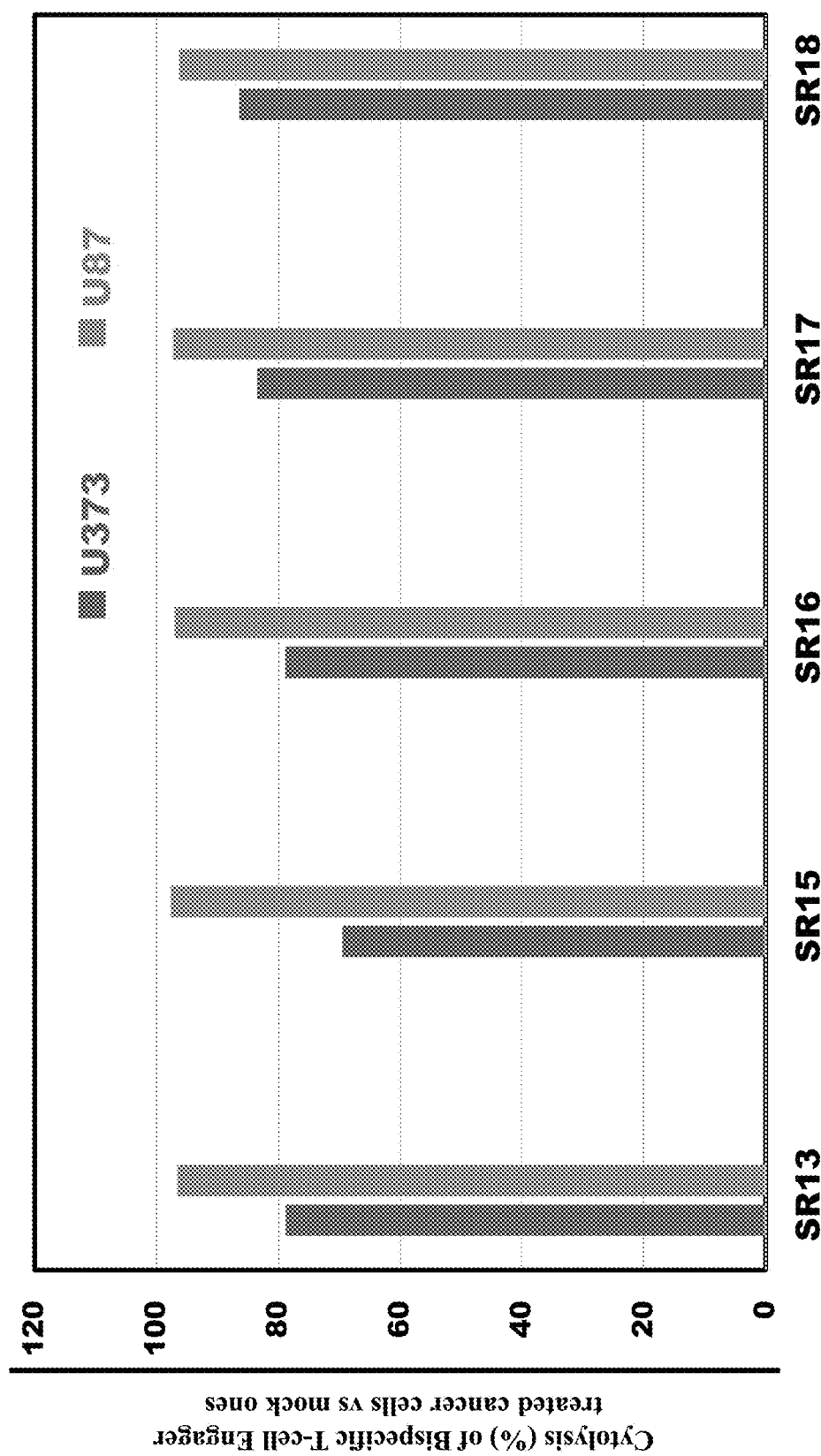
FIG. 8 shows results of luciferase-based killing assay. The data each was collected at 24 hours post BiTE treatment using the E/T ratio of 0.5 and is the average of the repeating assays (N=6; BiTE concentration: 5 ng/ml).
Figure 9:
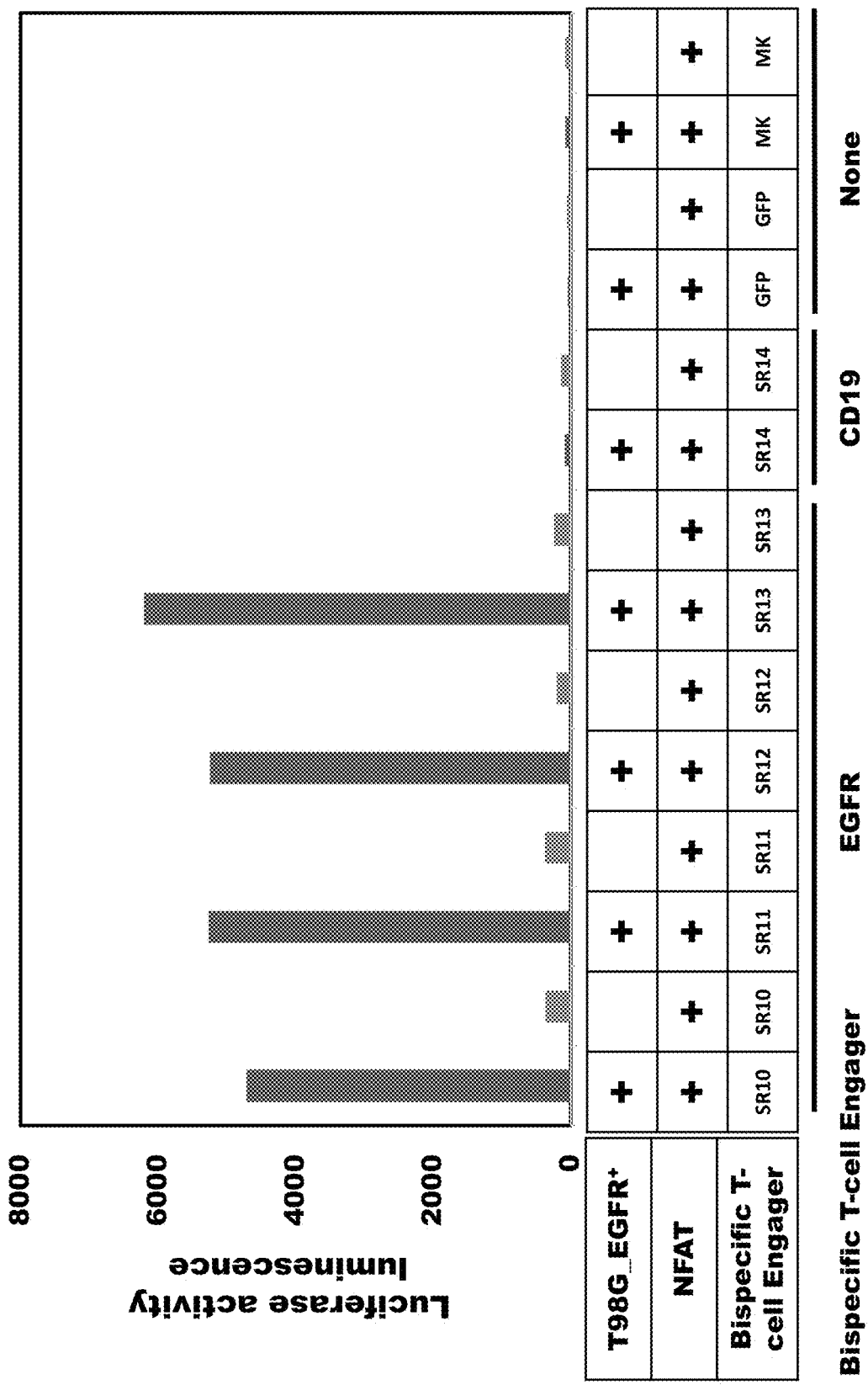
FIG. 9 shows results of NFAT-based BiTE induced T cell activation assay. The data each was collected at 24 hours post BiTE/NFAT treatment and is the average of repeating assays (N=3; E(NFAT)/T(T98G)=0.5; MK, mock).

Before two-domain and two-arm BiTEs were constructed, the one-arm BiTEs were constructed and screened using luciferase-based cytolysis assay (FIG. 6). After the lead clones of the one-arm BiTE were identified (FIG. 7), the two-domain and two-arm BiTEs were constructed (FIG. 6). The lead clones of two-domain and two-arm BiTE were identified using both luciferase-based cytolysis assay and NFAT-based BiTE-mediated T cell activation assay (FIGS. 8 & 9). The related killing activity scales are listed in Table 9.

Example 4. Identification of IL13R a2-HER2 Dual CAR_EGFR-BiTE Lead Clones SR20-22 and SR 24-26

Figure 15:
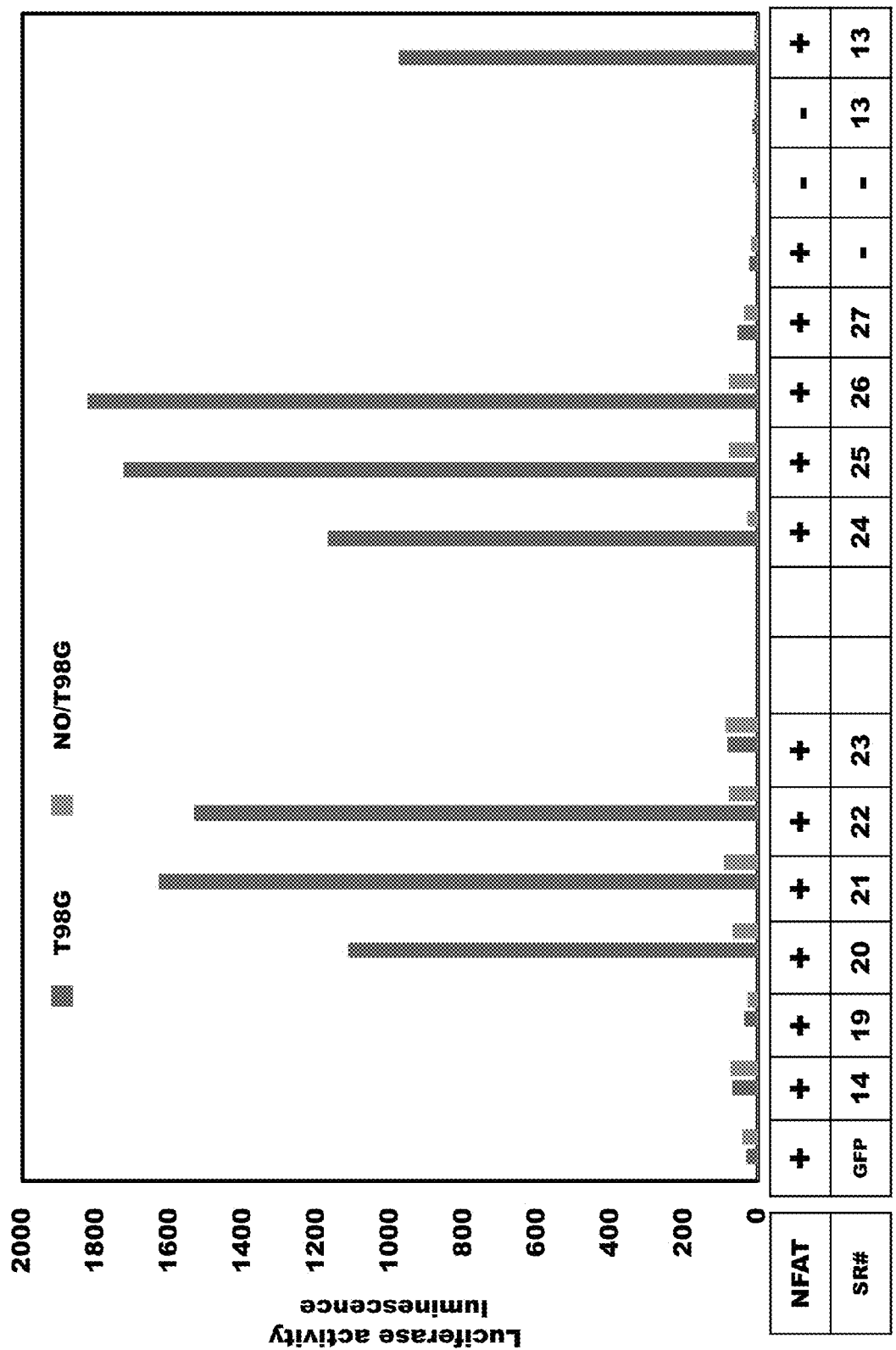
FIG. 15 shows results of NFAT-based BiTE induced T cell activation assay. The data each was collected at 24 hours post BiTE/NFAT treatment and is the average of repeating assays (N=3; E(NFAT)/T(T98G)=0.5; BiTE concentration: 5 ng/ml; GFP, negative control). The BiTEs used here were produced by constructs of Dual CAR-BiTE in 293T cells.
Figure 16:
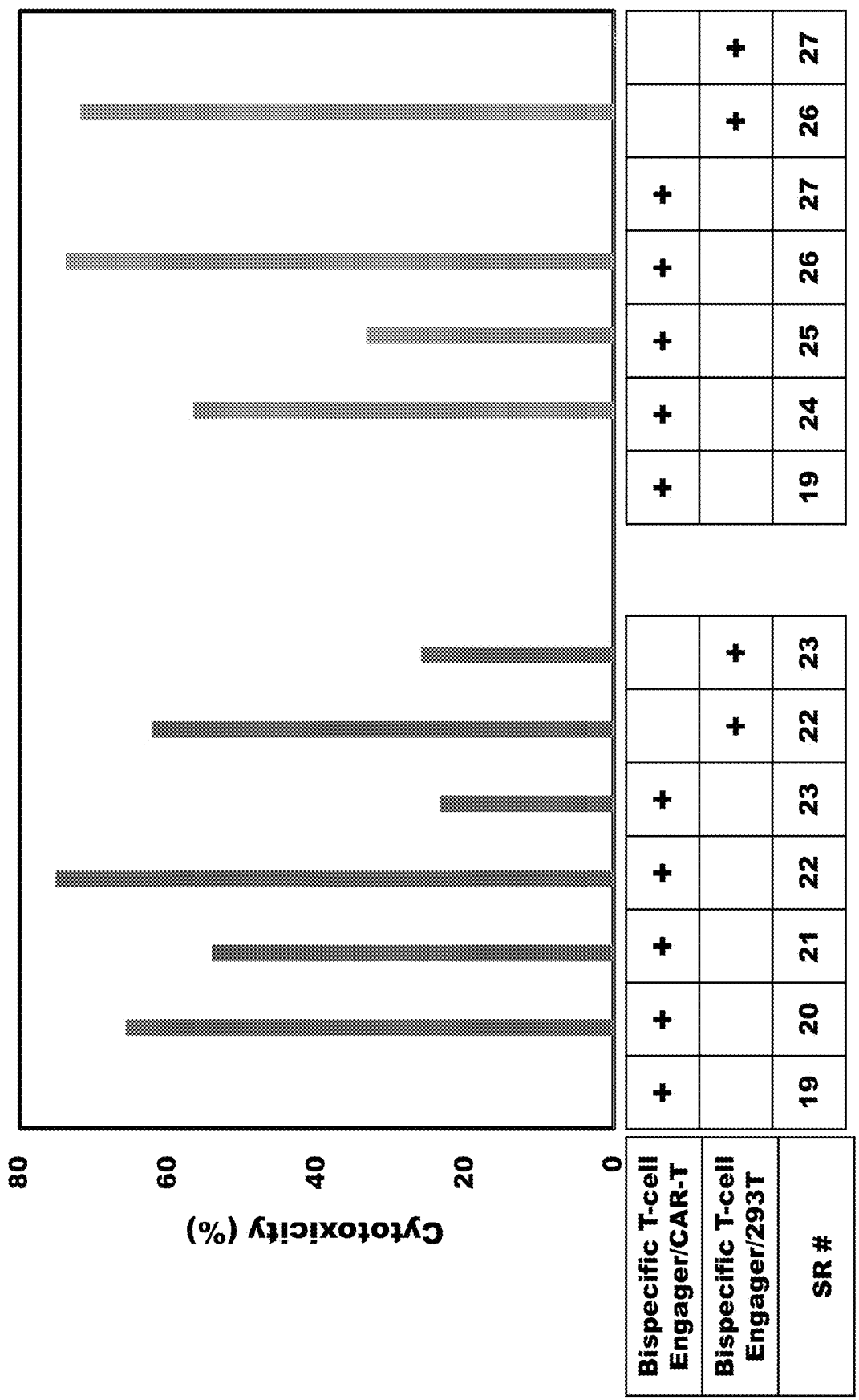
FIG. 16 shows results of luciferase-based killing assay, 20 hours after BiTE treatment of GBM line U87 using the E/T ratio of 0.5. The data each is the average of the repeating assays (N=6; BiTE concentration: 50 pg/ml (CART produced), 5 ng/ml (293T produced)).
Figure 17:
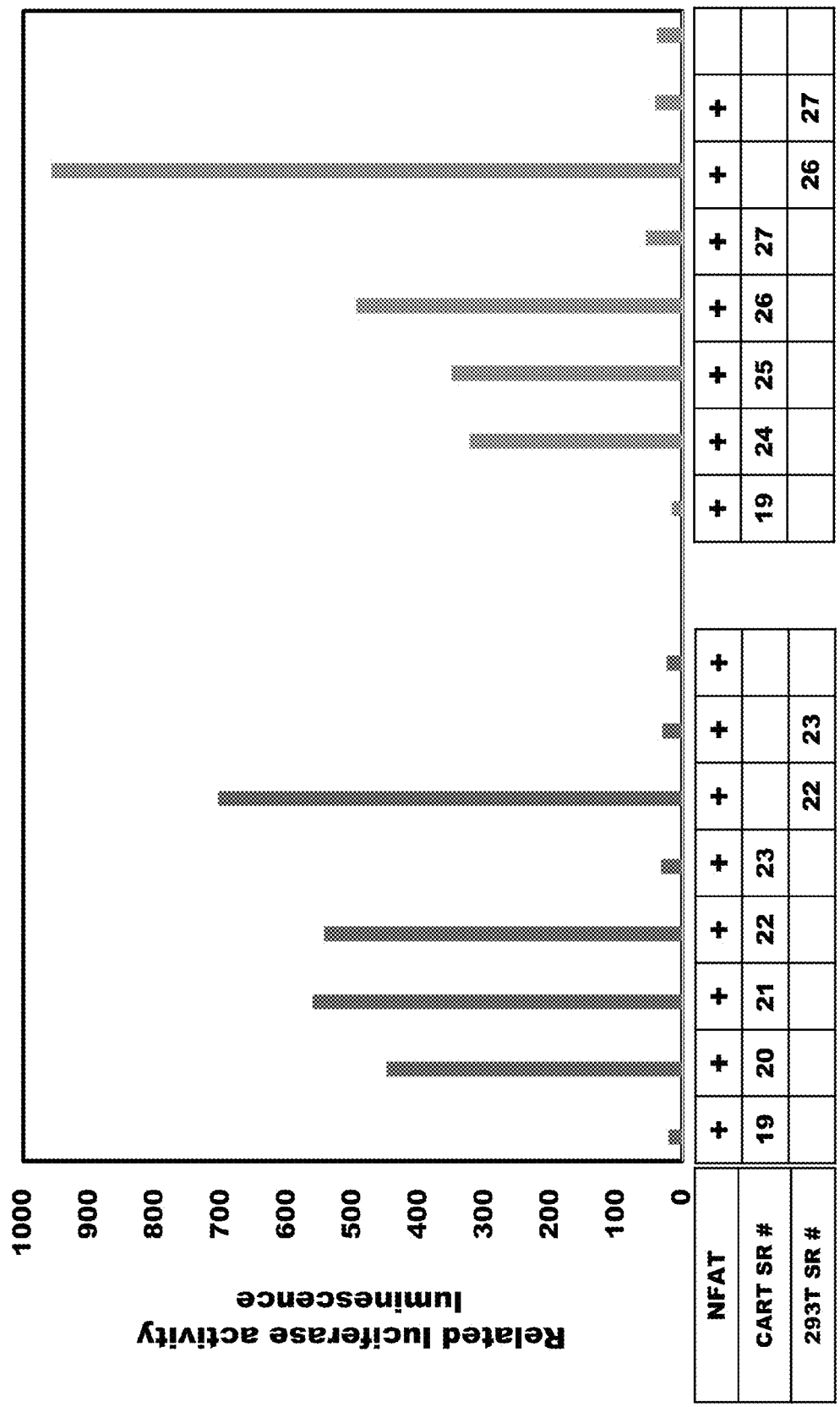
FIG. 17 shows results of NFAT-based BiTE inducing T cell activation assay. The data each was collected at 24 hours post BiTE/NFAT treatment and is the average of repeating assays (N=6; E(NFAT)/T(T98G)=0.5; BiTE concentration: 50 pg/ml (CART produced), 5 ng/ml (293T produced)).

After identification of the lead clones of dual CAR and BiTE, the combination constructs of "IL13Rα2-HER2 Dual CAR_EGFR-BiTE" were constructed as shown in FIG. 10. To verify the capability of the "Dual-CAR_BiTE" constructs to produce functional BiTE and to further identify the BiTE with better cytolysis activity, the BiTEs produced by both HEK293T cells (FIGS. 11-14) and primary human T cells (FIG. 16) were used to test the cytolysis capabilities. The capabilities of the BiTEs produced by HEK293T cells (FIG. 15) or by primary T cells (FIG. 17) to stimulated T cell activation were tested using NFAT-based luciferase assay.

Figure 18:
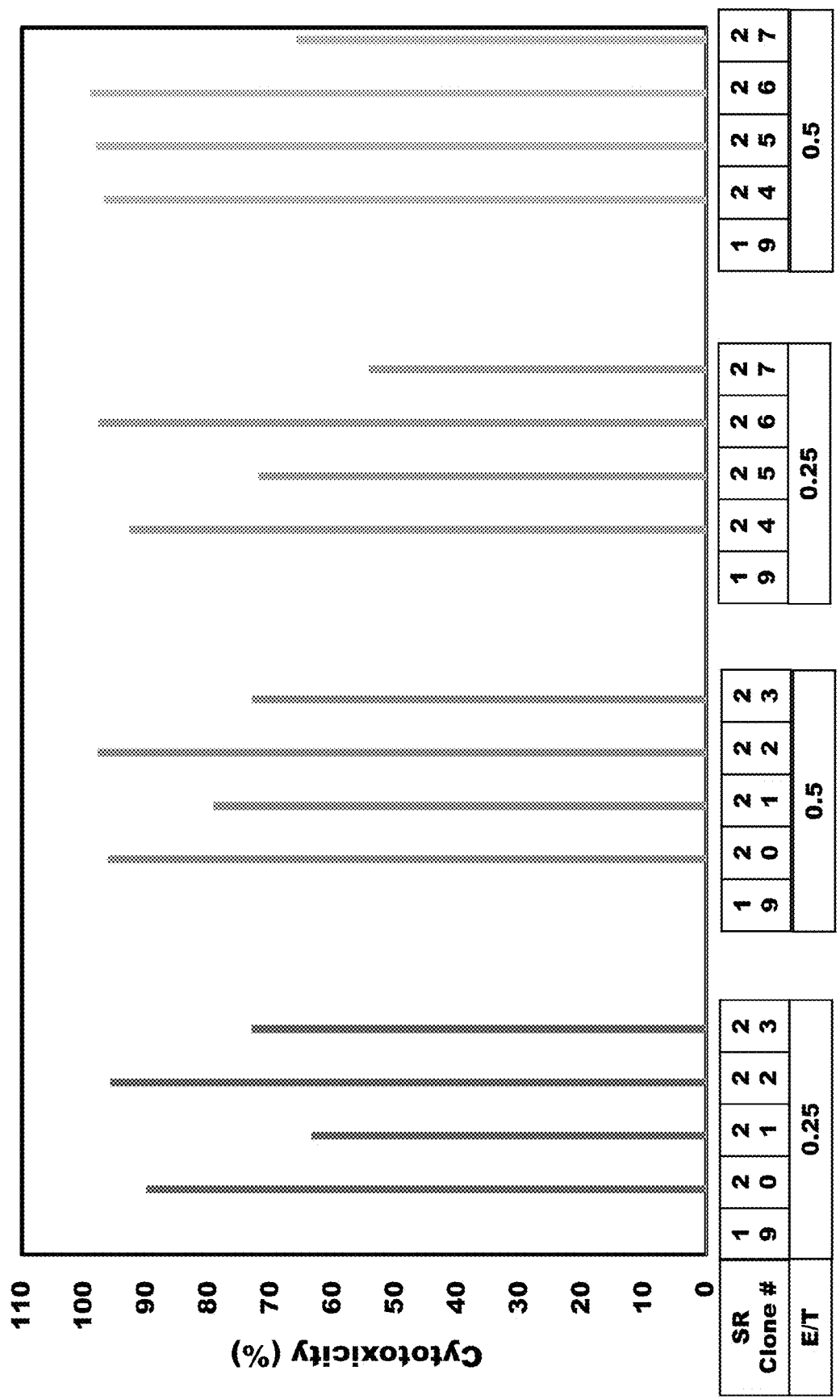
FIG. 18 shows results of luciferase-based killing assay. The data each was collected at 24 hours post CAR-T treatment of GBM line U87 and is the average of the repeating assays (N=3).
Figure 19:
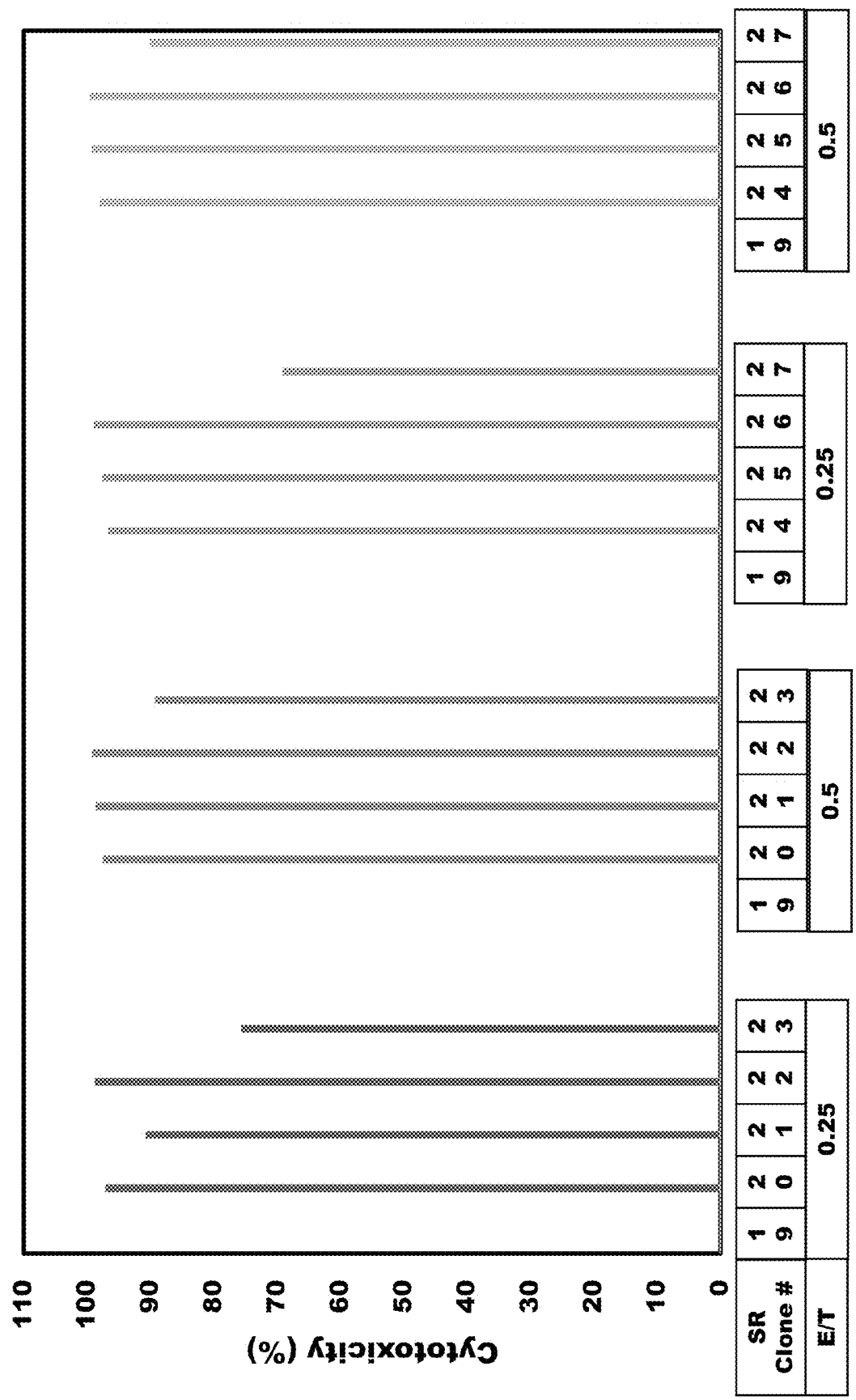
FIG. 19 shows results of luciferase-based killing assay. The data each was collected at 48 hours post CAR-T treatment of GBM line U87 and is the average of the repeating assays (N=3).
Figure 20:
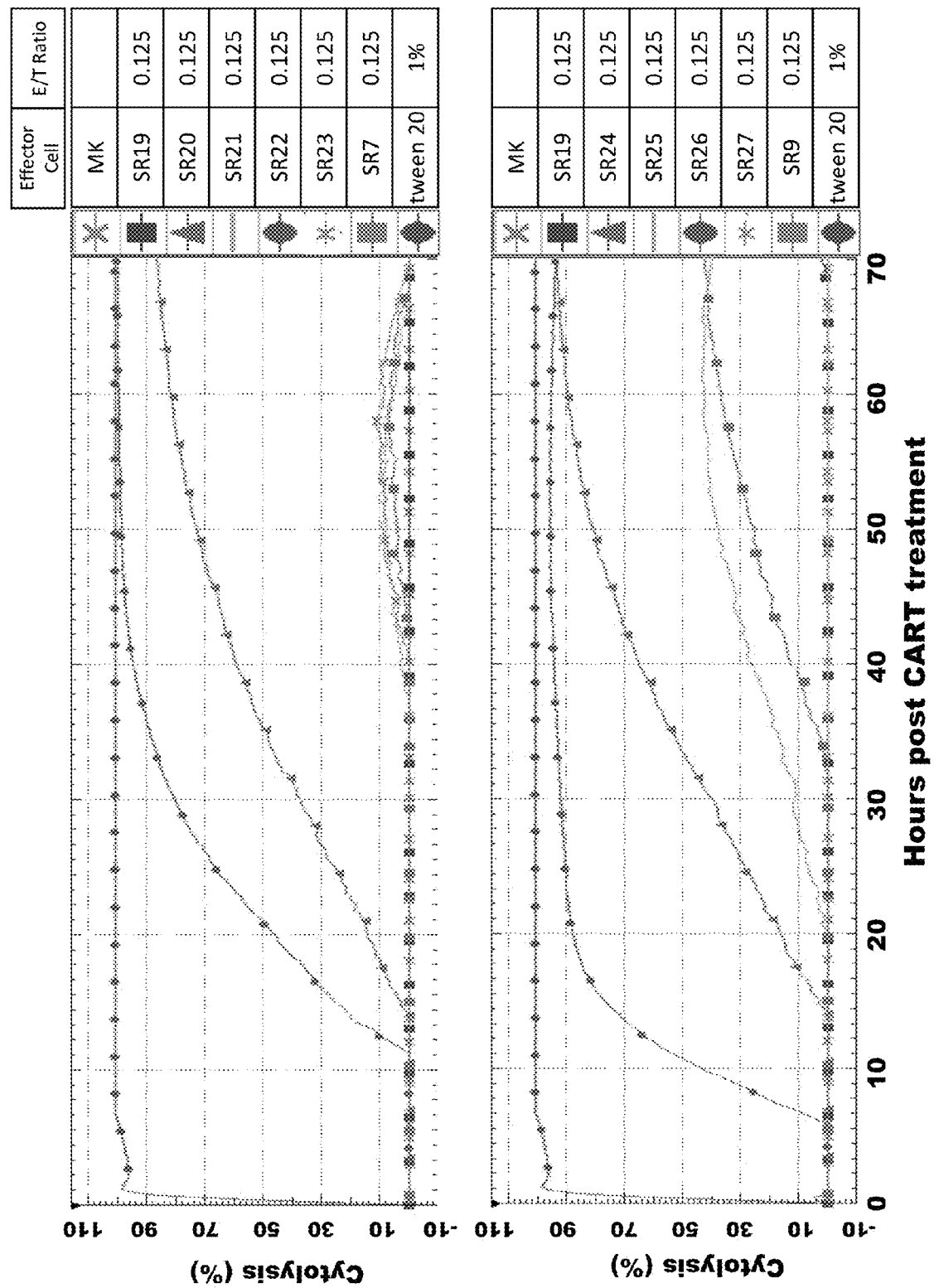
FIG. 20 shows results of RTCA-based killing assay. The target cancer cell line is GBM line U87. The data each is the average of the repeating assays (N=3). This set of data is representative of three donors' CAR-T cells treatment ones.
Figure 21:
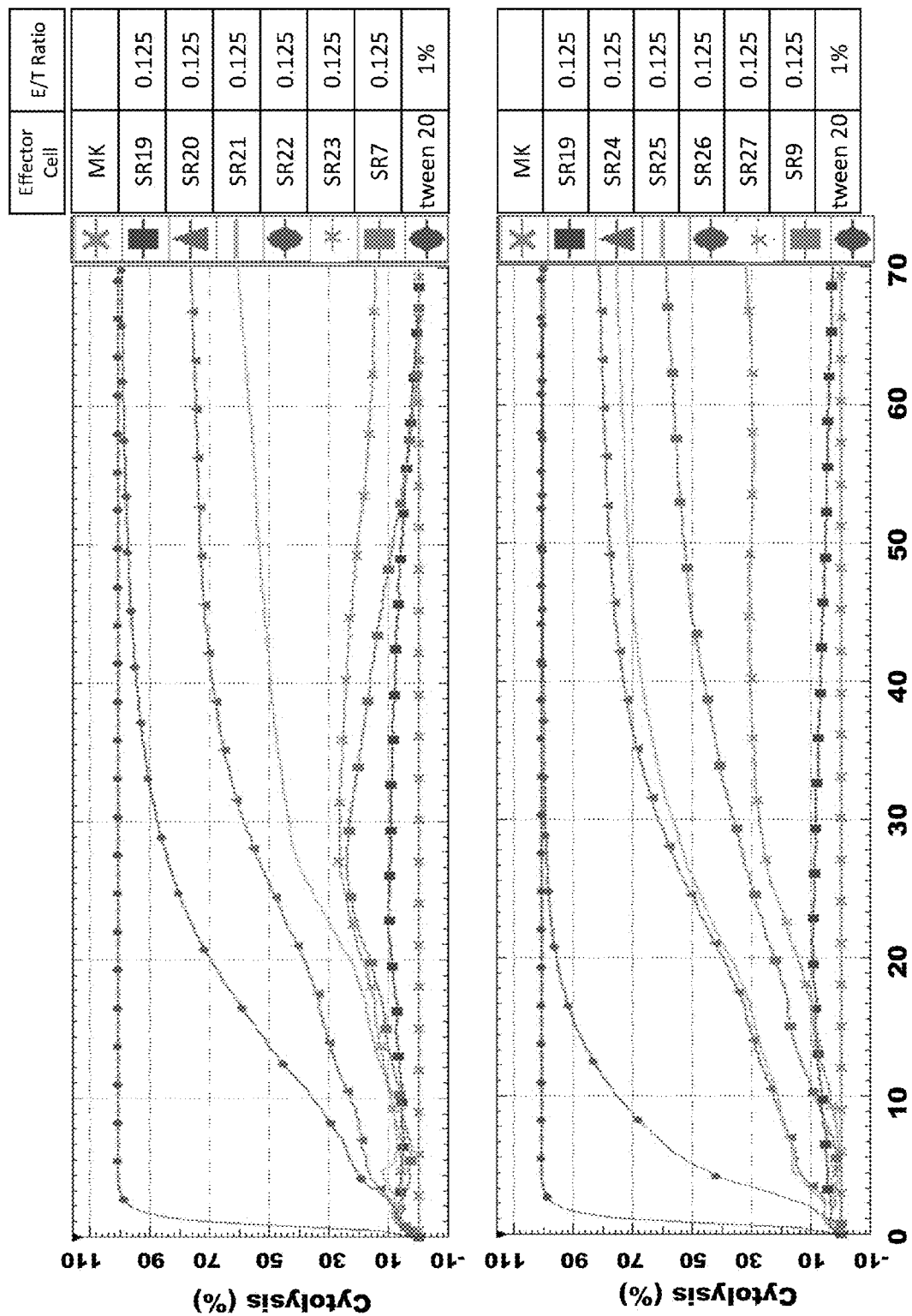
FIG. 21 shows results of RTCA-based killing assay. The target cancer cell line is GBM line T98G. The data each is the average of the repeating assays (N=3). This set of data is representative of three donors' CAR-T cells treatment ones.
Figure 22:
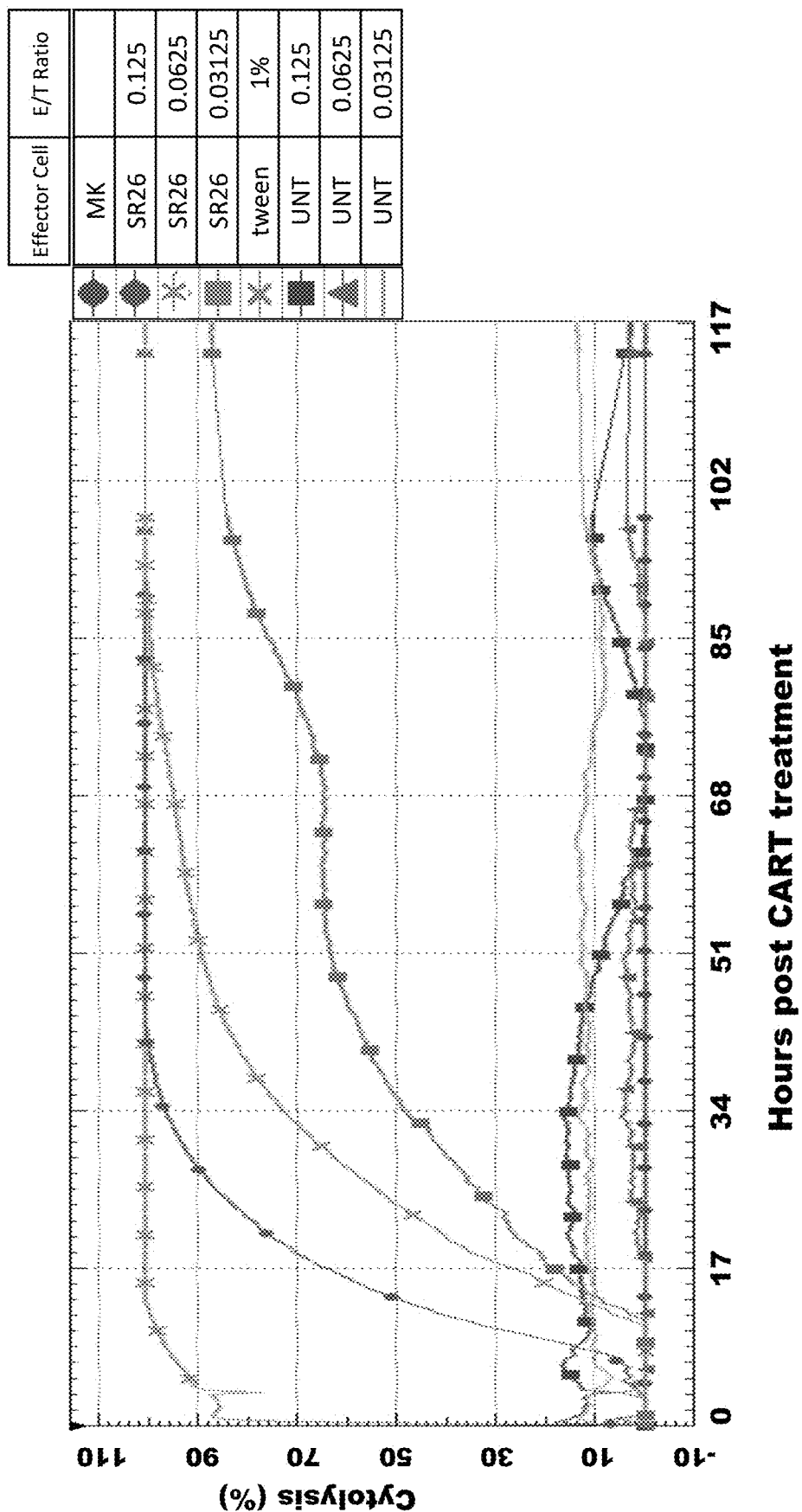
FIG. 22 shows results of RTCA-based killing assay. The target cancer cell line is GBM line U87. The data each is the average of the repeating assays (N=6). MK, mock; UNT, Pan T cells.
Figure 23:
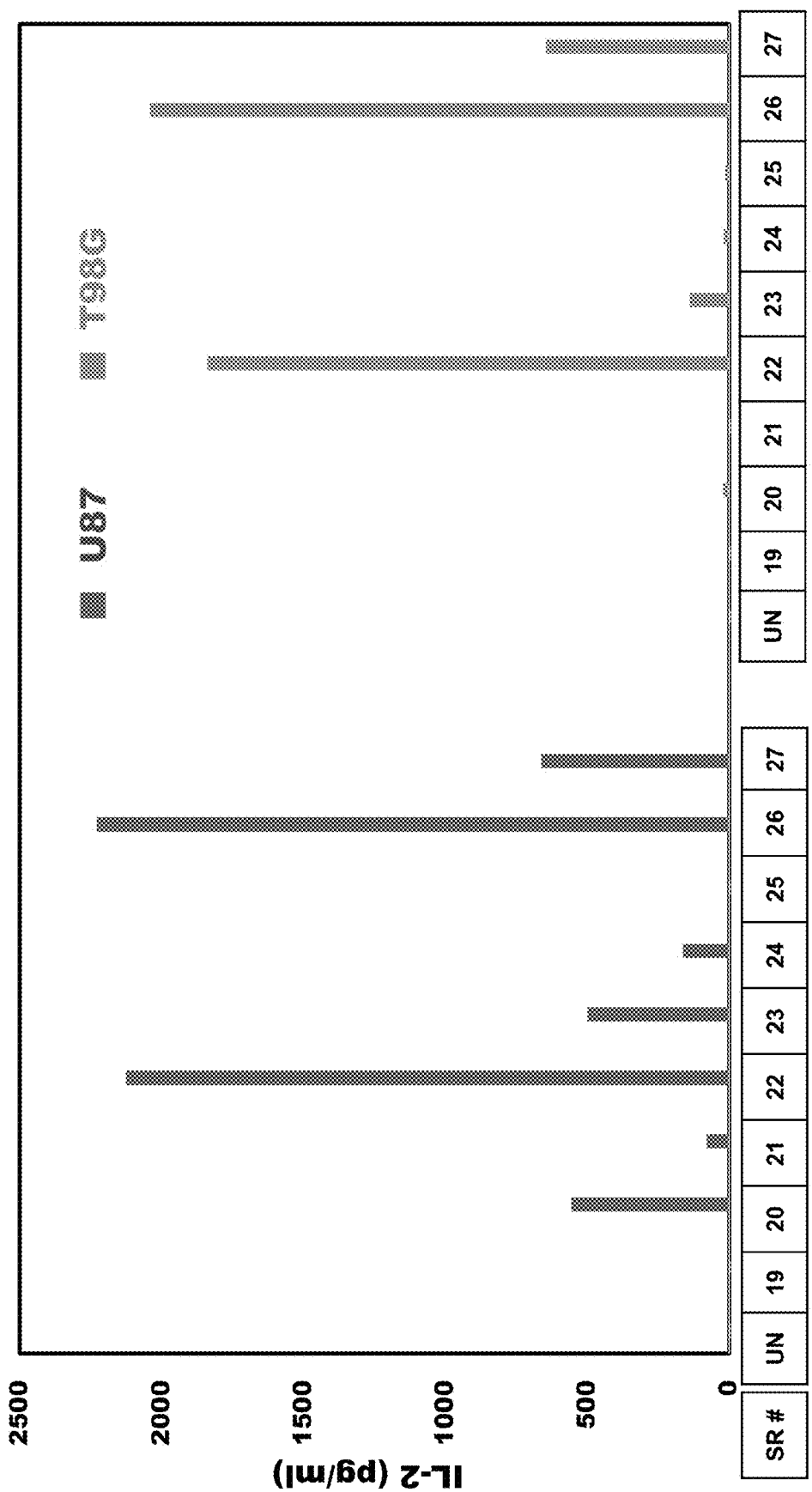
FIG. 23 shows results of cytokine release assay. The data each was collected at 48 hours post CAR-T treatment using the E/T ratio of 0.125 (total $CAR^+$ T cells: 2,500) and is the average of the repeating assays (N=3). UN: Pan T cells.
Figure 24:
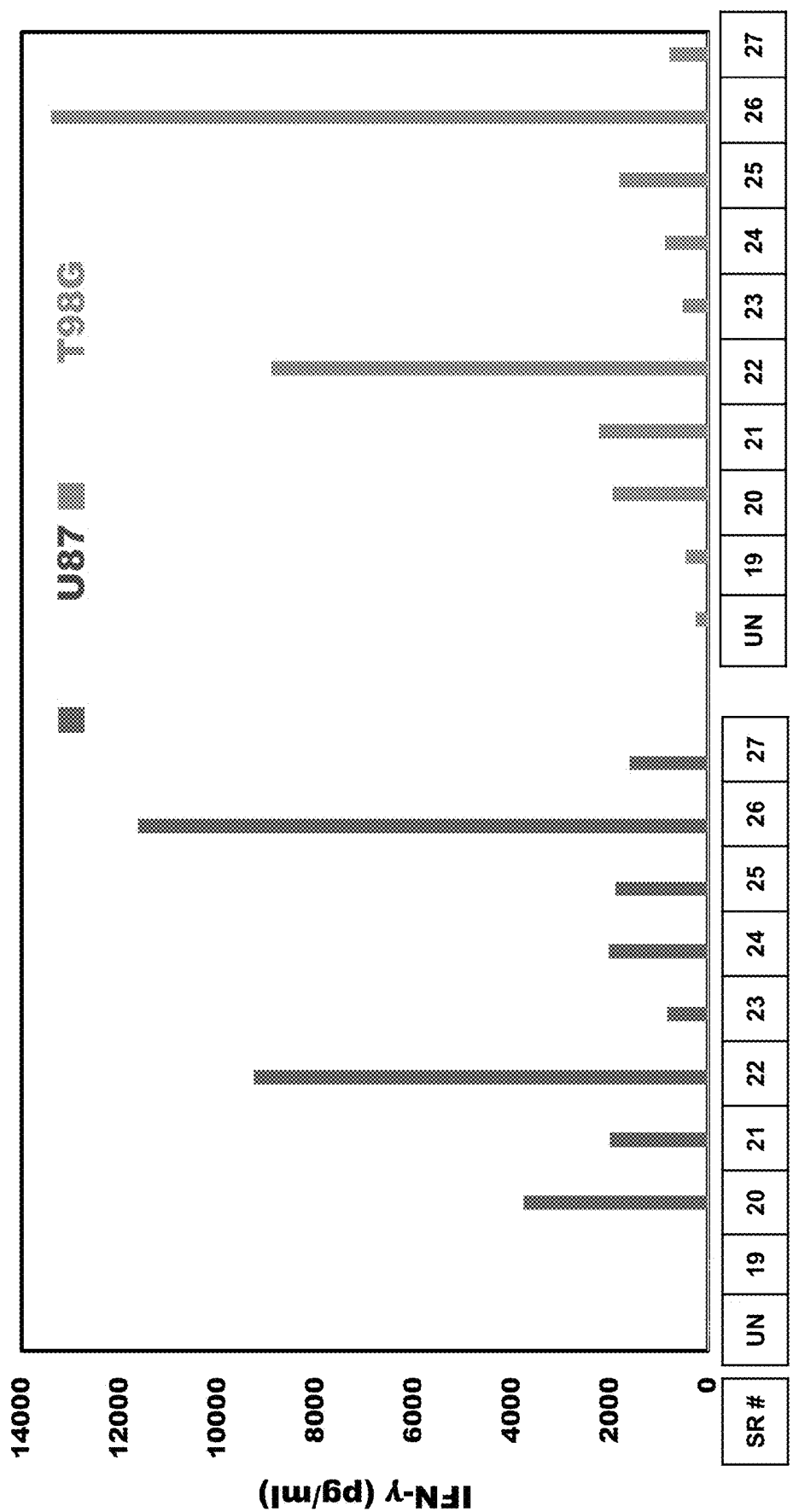
FIG. 24 shows results of cytokine release assay. The data each was collected at 48 hours post CAR-T treatment using the E/T ratio of 0.125 (total $CAR^+$ T cells: 2,500) and is the average of the repeating assays (N=3). UN: Pan T cells.

After confirmation of the cytolysis activities of the BiTEs, the synergistic cytolysis activities of the "Dual-CAR_BiTE" clones were analyzed using both luciferase-based killing assay (FIGS. 18 & 19) and RTCA-based cytolysis assay (FIGS. 20-22).

To further evaluate the BiTE armed dual CAR-T lead clones, cytokines released by the CAR T cells were assessed using ELISA assays. Both IL-2 and IFNγ were tested (FIGS.

23 & 24). Through these serial assays, the lead clone of BiTE-armed dual CAR-T, SR26, was identified. The related killing activity scales are listed in Table 9.

Example 5. Serial Killing Activity Assay of SR26, One of Lead Clones

Figure 25:
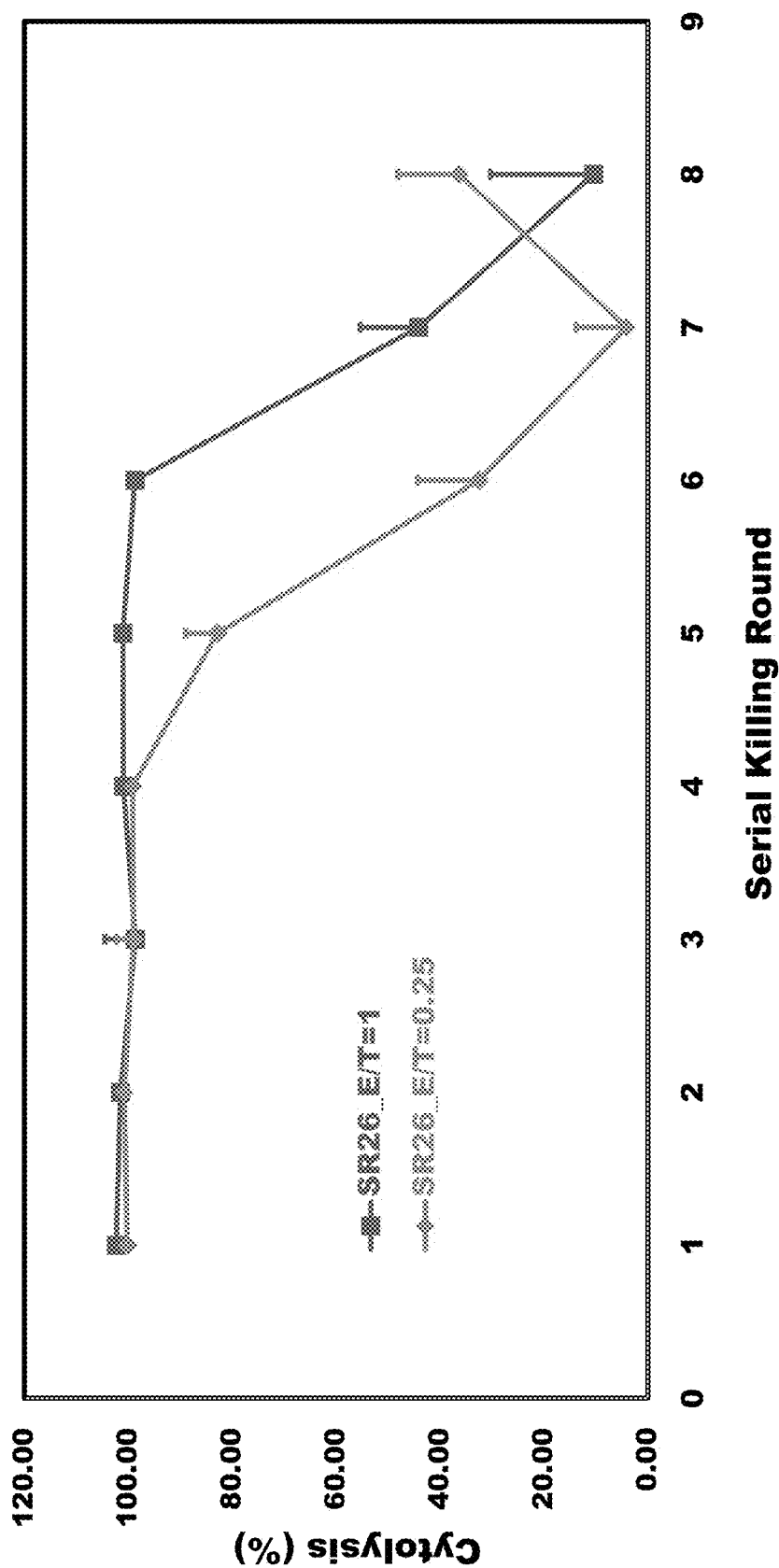
FIG. 25 shows results of luciferase-based serial killing assay. The data each was collected at 24 hours post of CAR-T treatment of GBM line U87 and is the average of the repeating assays (N=18). At serial 5 killing assay, the expanded CAR-T cells were diluted to corresponding E/T ratio concentration.
Figure 26:
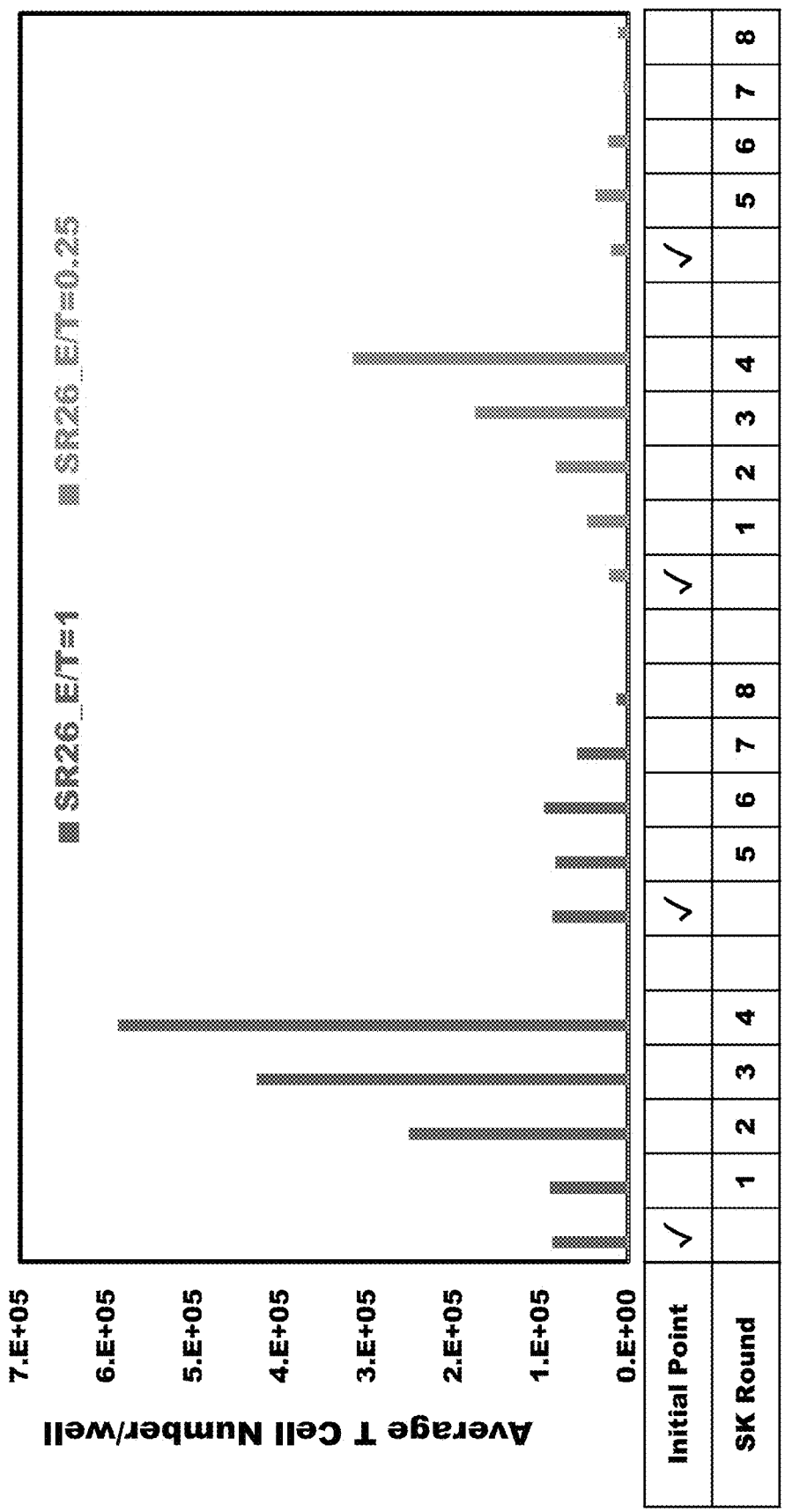
FIG. 26 shows results of T cell expansion capability assay during CART serial killing. The data each was collected at 24 hours post CAR-T treatment of GBM line U87 and is the average of the repeating assays (N=18). At serial 5 killing assay, the expanded CAR-T cells were diluted to corresponding E/T ratio concentration. SK: serial killing.
Figure 27:
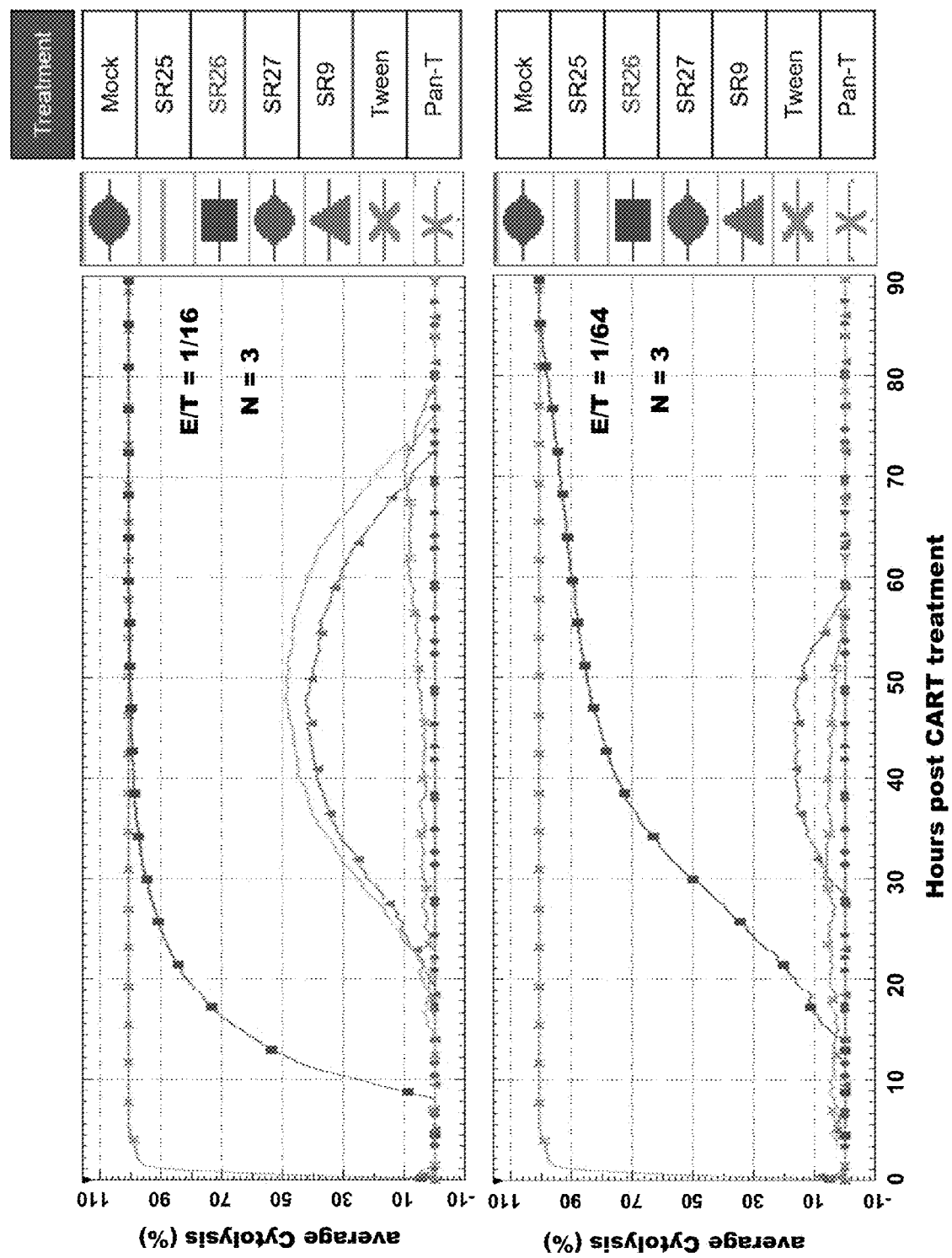
FIG. 27 shows results of RTCA-based killing assay targeting GBM line U87 at an extremely low E/T ratio (E:T=1:16) (N=3). SR26 (two-armed BiTE CAR-T cell) shows continuous cytolytic activity compared to SR25 (one-armed BiTE CAR-T cell), SR27 (control CD19 BiTE CAR-T cell) and SR9 (dual CAR-T cell).
Figure 28:
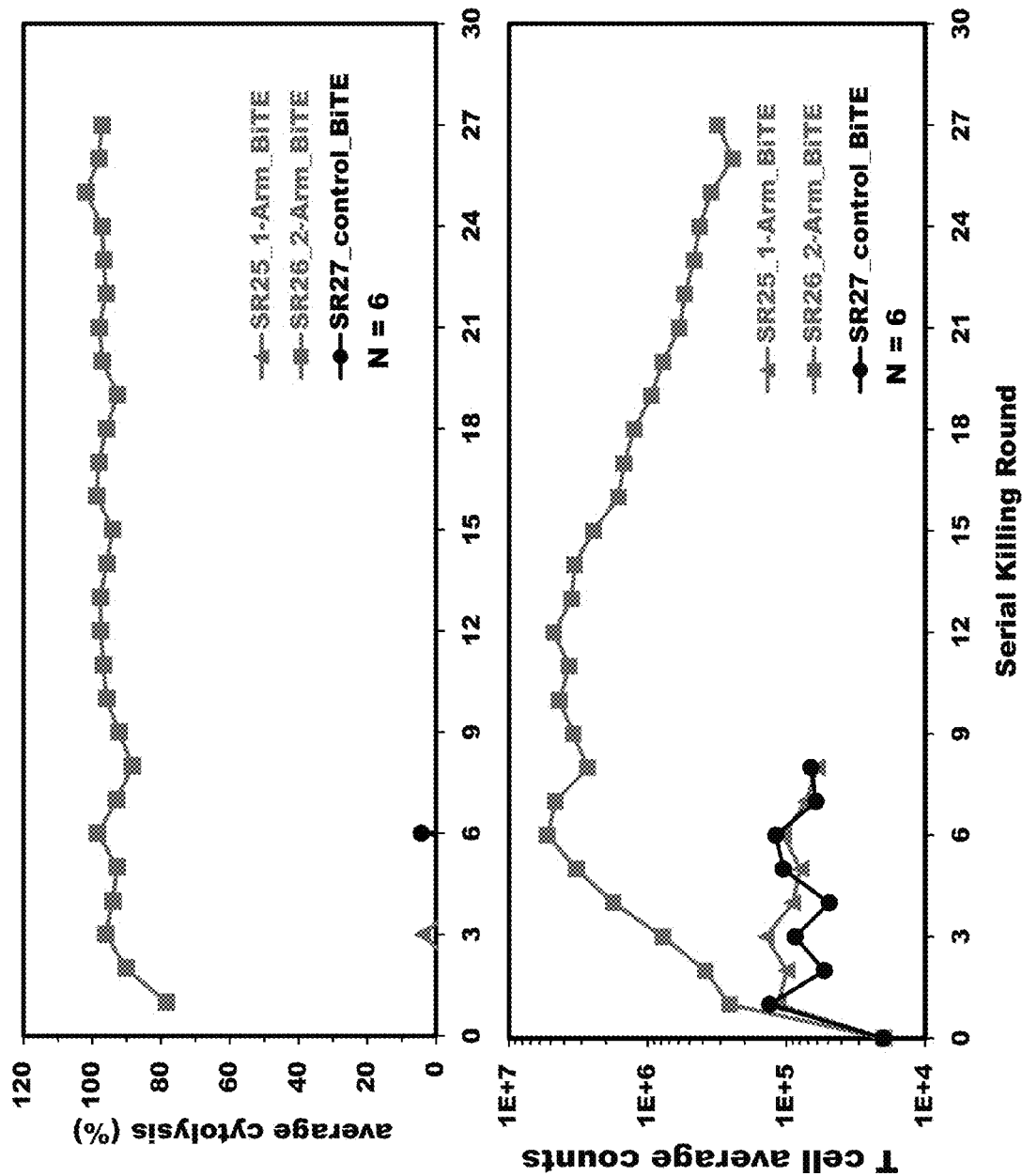
FIG. 28 shows results of serial killing assay targeting GBM line U87 at a low E/T ratio (E:T=1:1) and extremely low concentration ([BiTE]=0.2 ng/ml) (N=3). Comparing to SR25, SR26 shows a balance between continuous cytolytic activity and T cell persistence.
Figure 29:
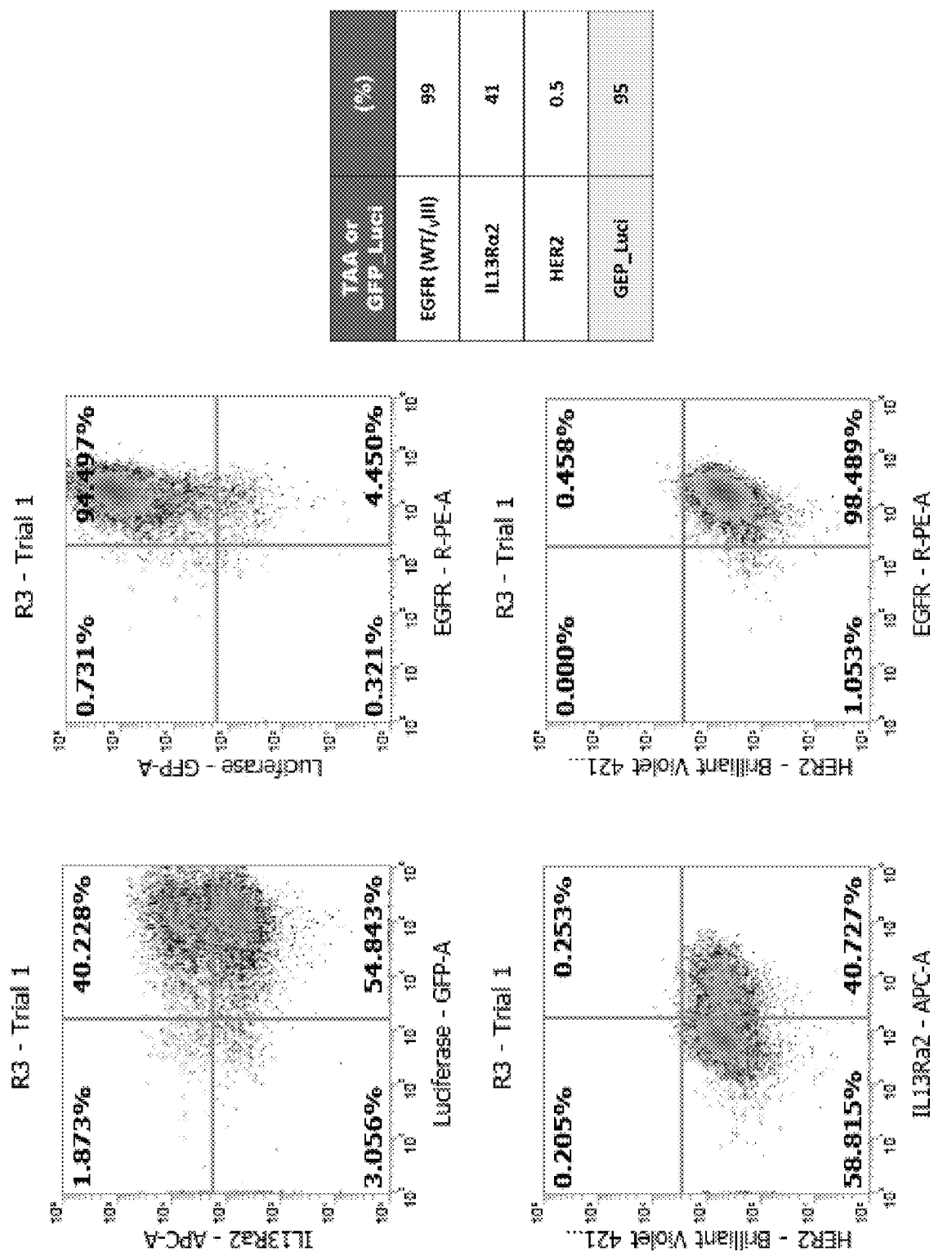
FIG. 29 shows FACS results characterizing cell surface expression of tumor-associated antigen (TAA) in the U87 GBM line expressing GFP and luciferase. EGFR, Her2 and IL13R2a were detected using anti-human EGFR, anti-Her2 and anti-IL13R2a antibody clones.
Figure 30:
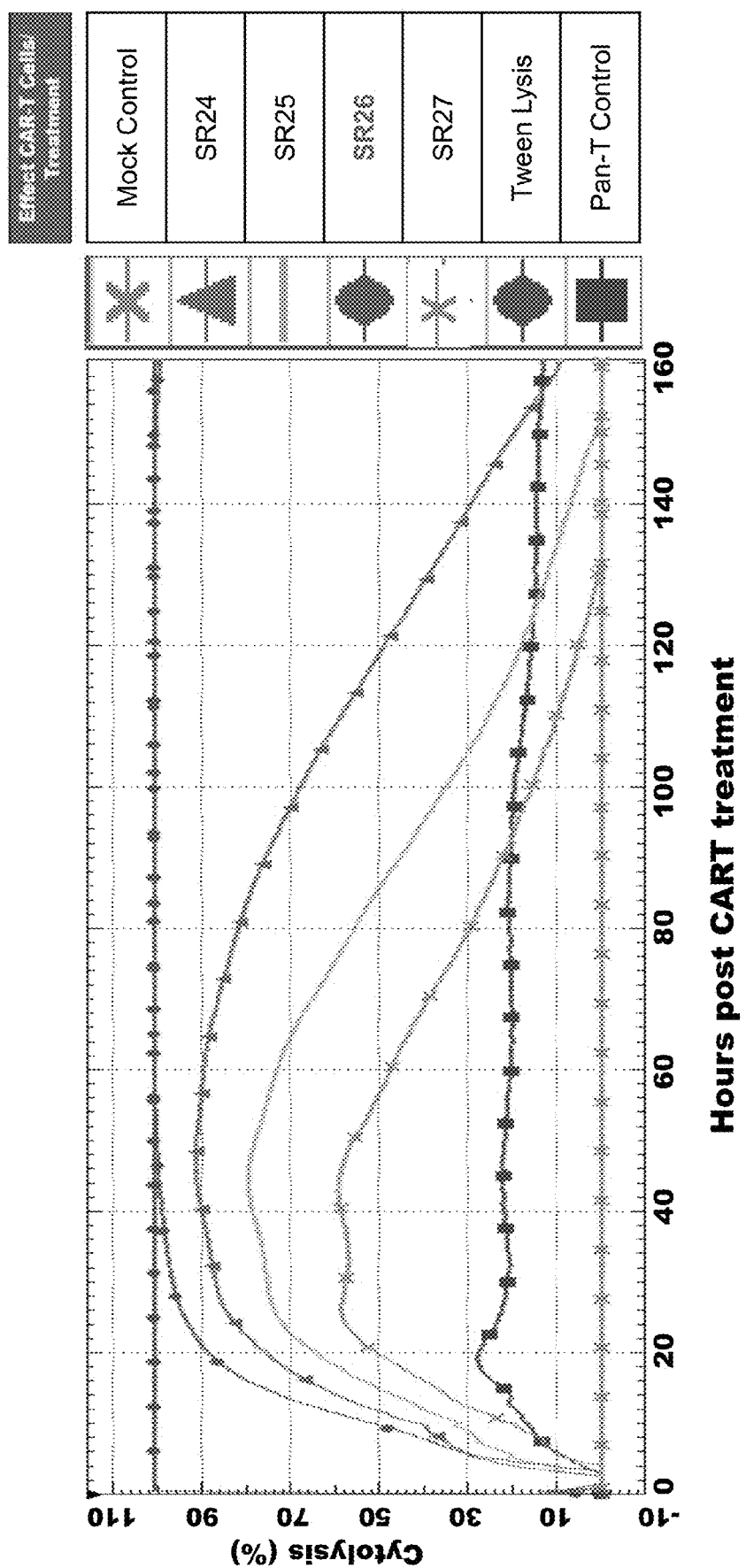
FIG. 30 shows results of RTCA-based killing assay targeting GBM line U251 at an extremely low E/T ratio (E:T=1:16) (N=6). SR26 shows continuous cytolytic activity compared to SR24 and SR25.
Figure 32:
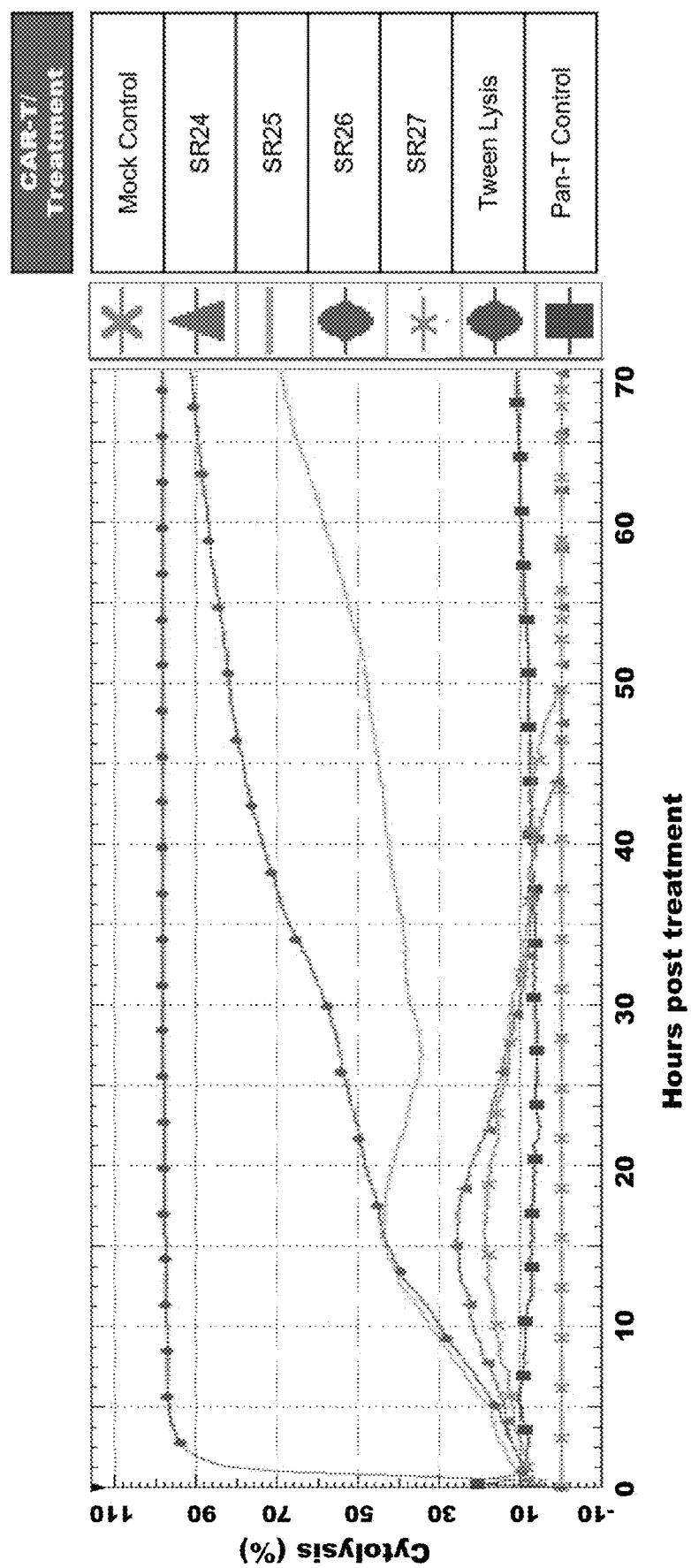
FIG. 32 shows results of RTCA-based killing assay at a low E/T ratio (E:T=1:8) (N=3). The target cancer cell line is the A431 HER2-positive breast cancer cell line. SR26 (two-armed BiTE CAR-T cell) shows better continuous cytolytic activity compared to SR24 and SR25 (one-armed BiTE CAR-T cells) and SR27 (CAR-T cell).
Figure 33:
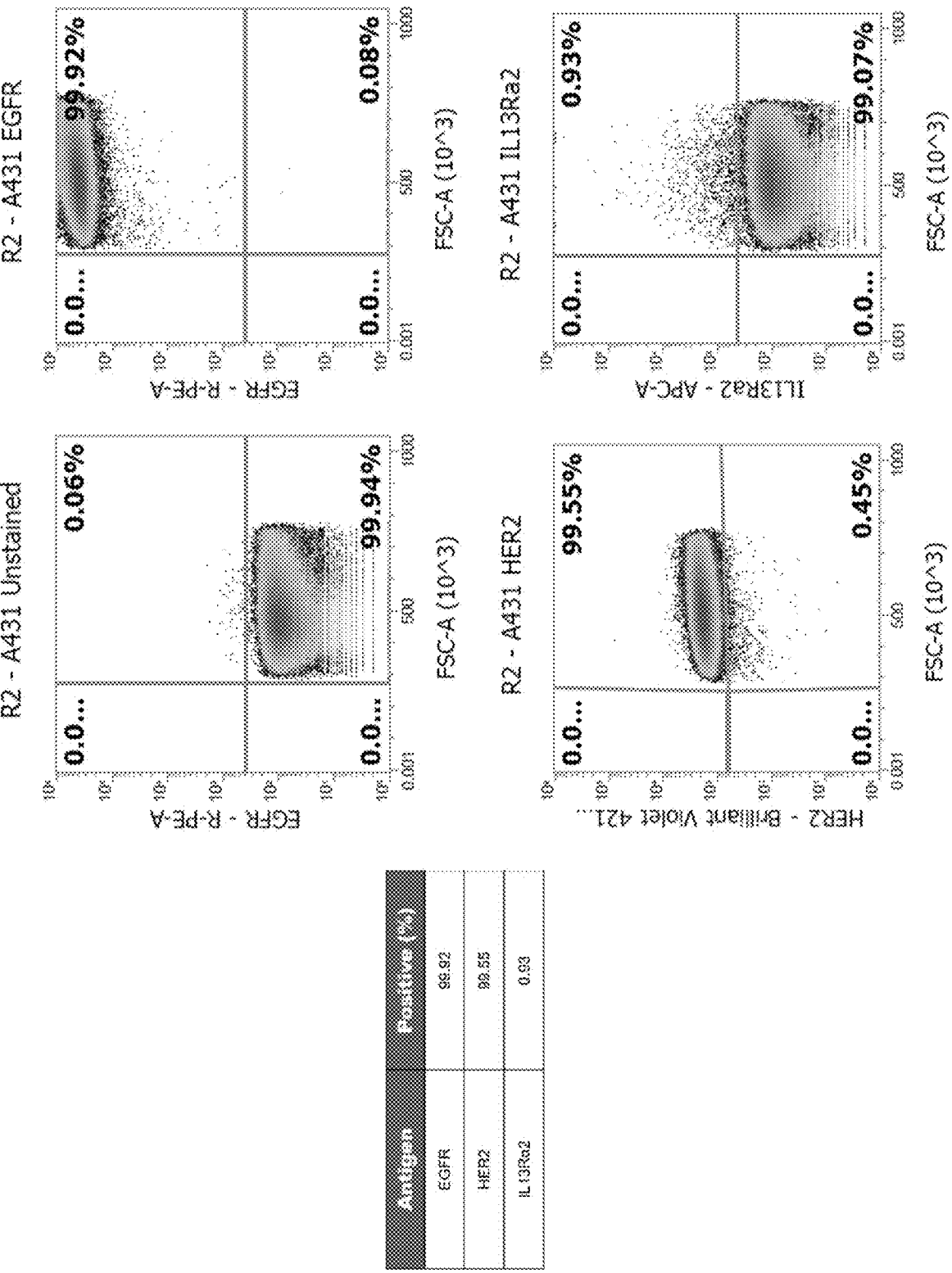
FIG. 33 shows EGFR, HER2 and IL13Rα2 expression level in the HER2-positive breast cancer cell line A431.
Figure 34:
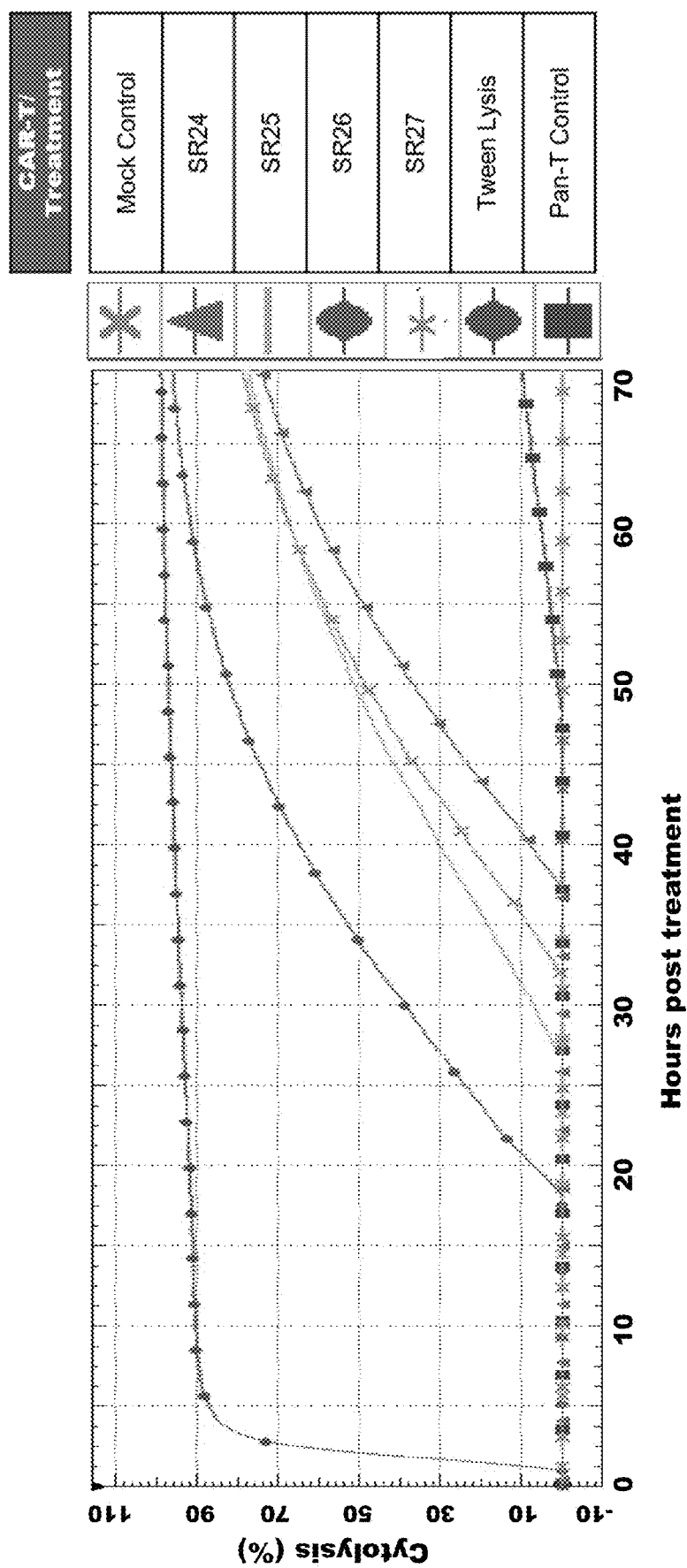
FIG. 34 shows results of RTCA-based killing assay at a low E/T ratio (E:T=1:8) (N=3). The target cancer cell line is the MCF-7 HER2-positive breast cancer cell line. SR26 (two-armed BiTE CAR-T cell) shows better continuous cytolytic activity compared to SR24 and SR25 (one-armed BiTE CAR-T cells) and SR27 (CAR-T cell).
Figure 35:
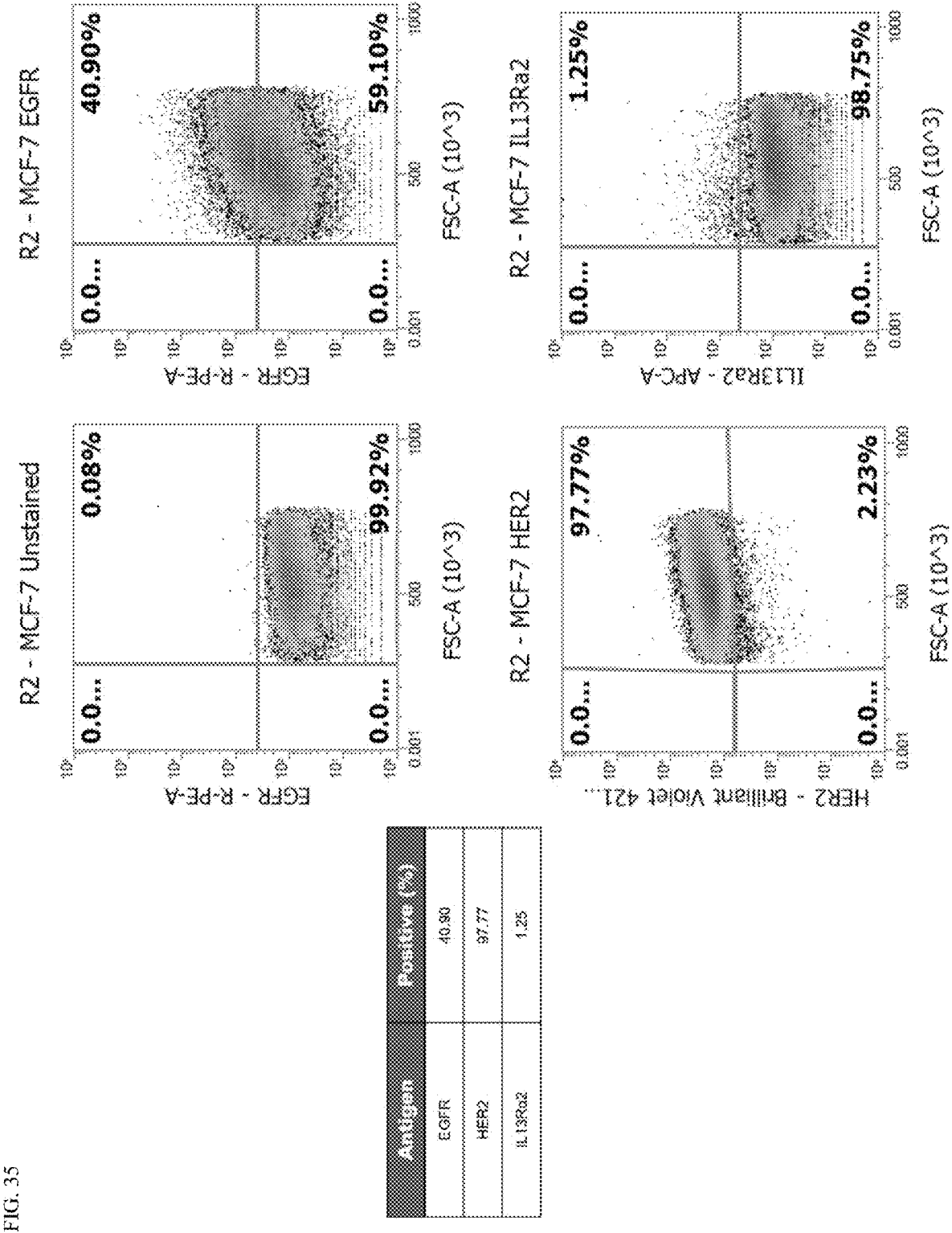
FIG. 35 shows EGFR, HER2 and IL13Rα2 expression levels in the HER2-positive breast cancer cell line MCF-7.
Figure 36:
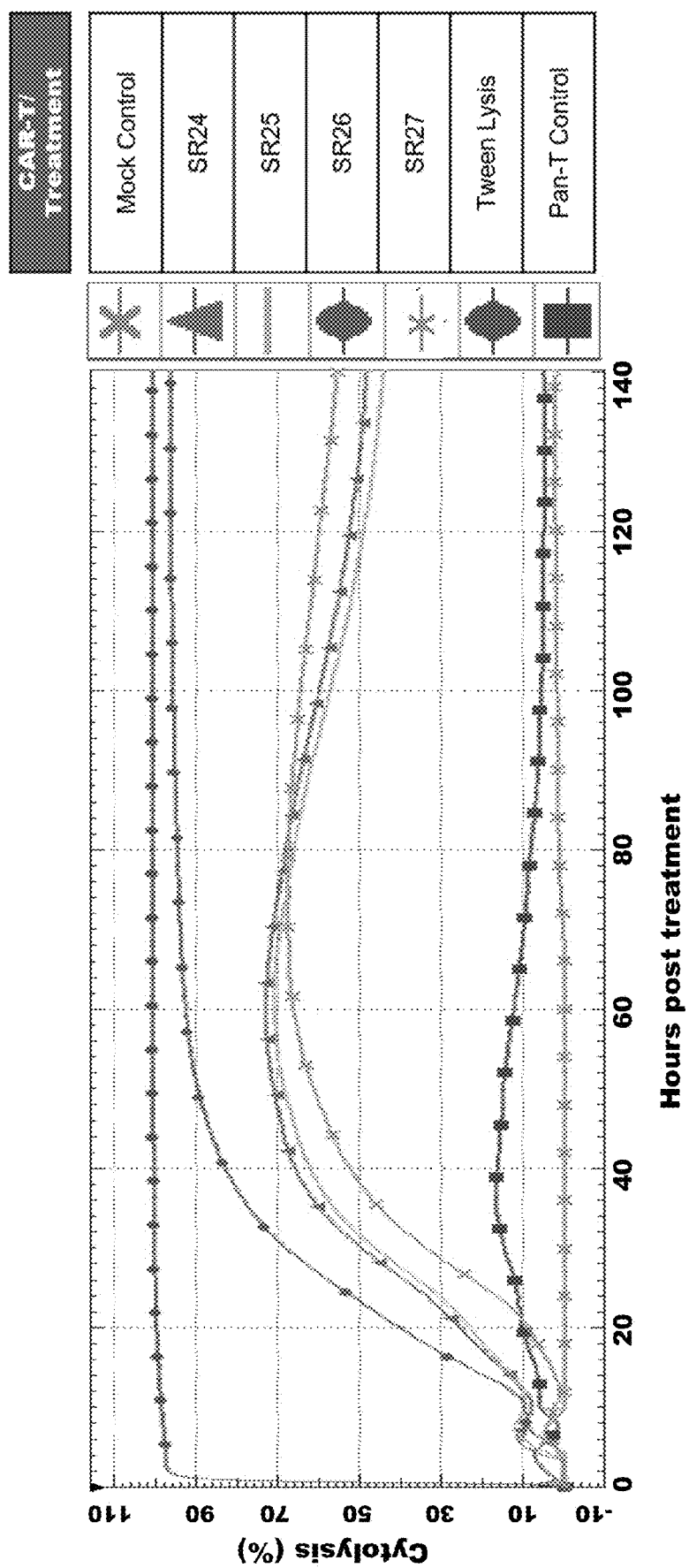
FIG. 36 shows results of RTCA-based killing assay at a low E/T ratio (E:T=1:8) (N=3). The target cancer cell line is NSCLC cell line (H-1944). SR26 (two-armed BiTE CAR-T cell) shows better continuous cytolytic activity compared to SR24 and SR25 (one-armed BiTE CAR-T cells) and SR27 (CAR-T cell).
Figure 37:
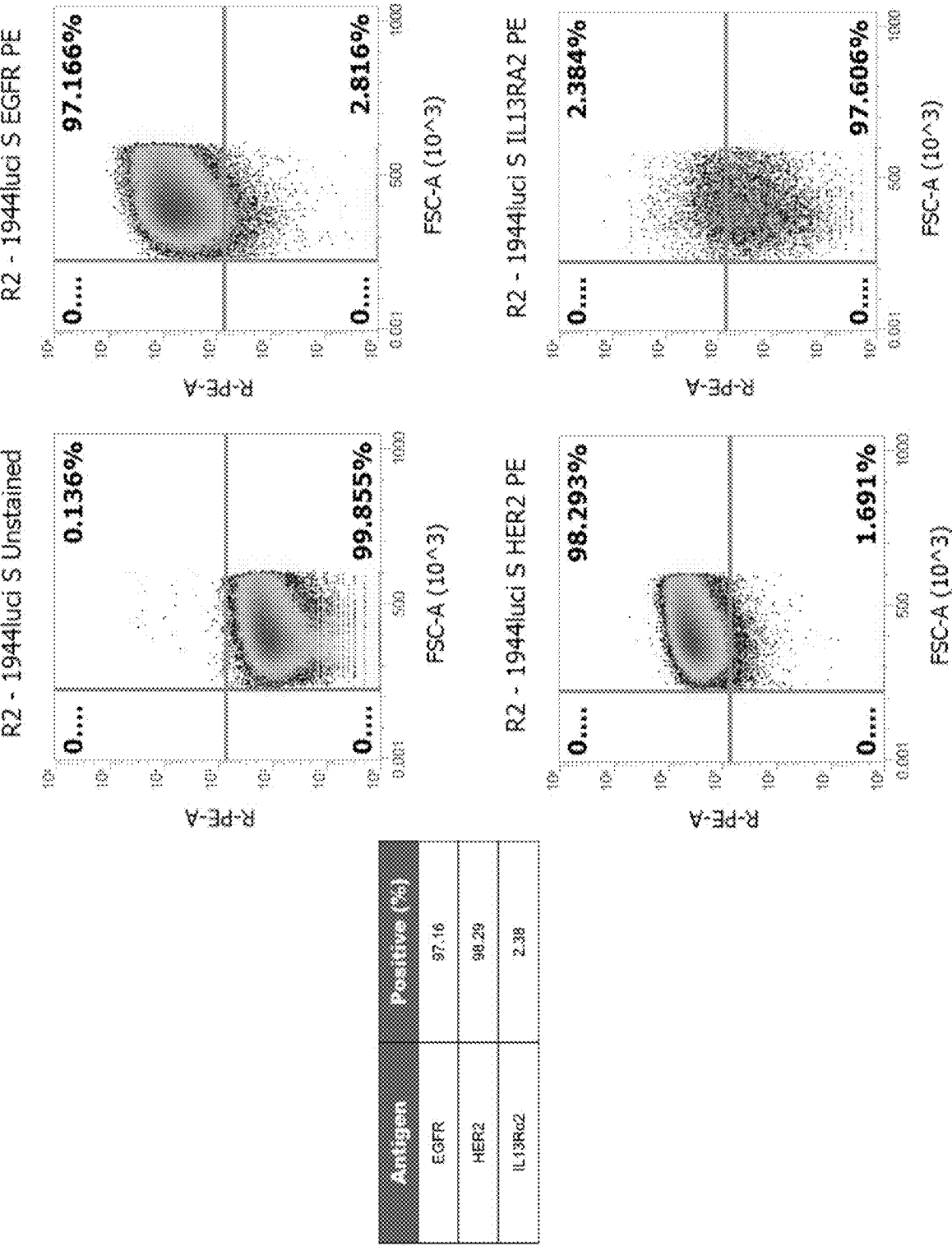
FIG. 37 shows EGFR, HER2 and IL13Rα2 expression levels in the NSCLC cell line H1944.
Figure 38:
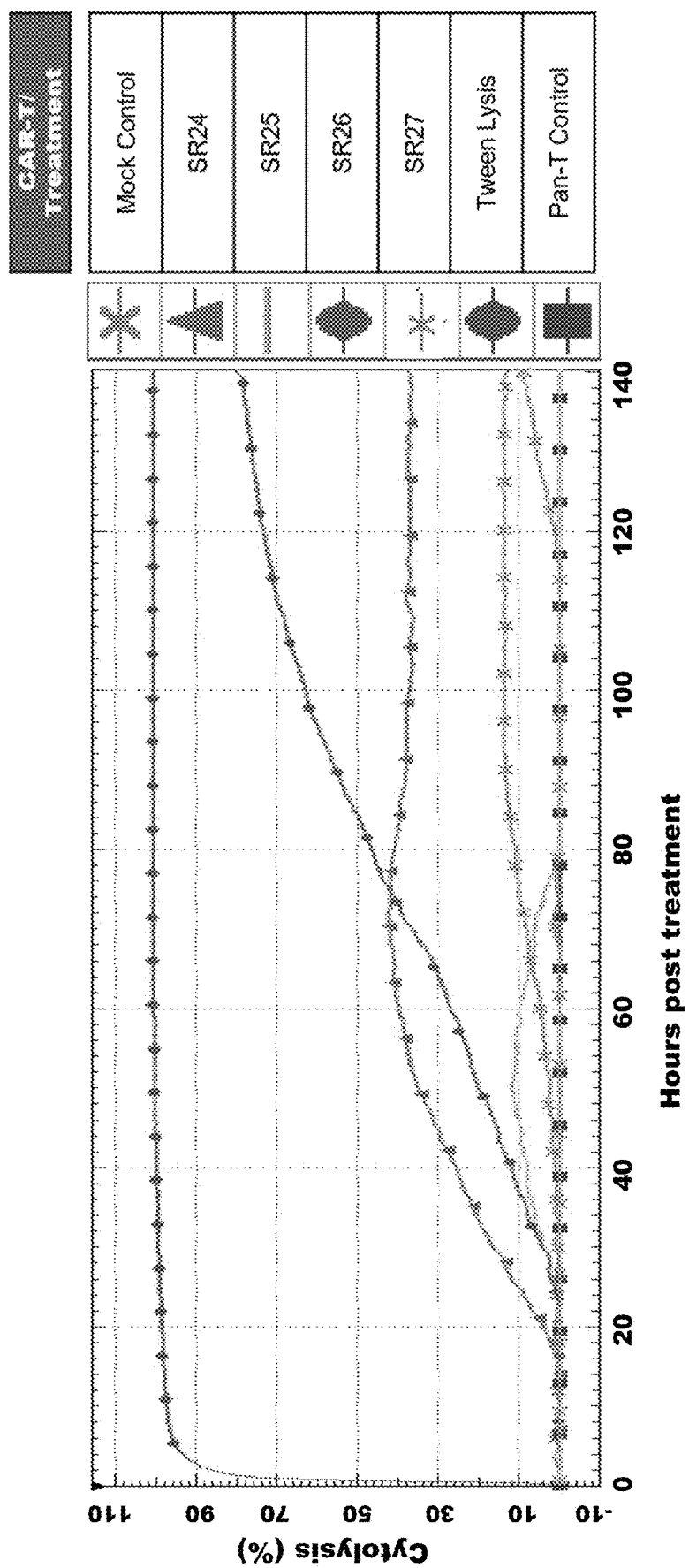
FIG. 38 shows results of RTCA-based killing assay at a low E/T ratio (E:T=1:4) (N=3). The target cancer cell line is NSCLC cell line (H-1915). SR26 (two-armed BiTE CAR-T cell) shows better continuous cytolytic activity compared to SR24 and SR25 (one-armed BiTE CAR-T cells) and SR27 (CAR-T cell).
Figure 39:
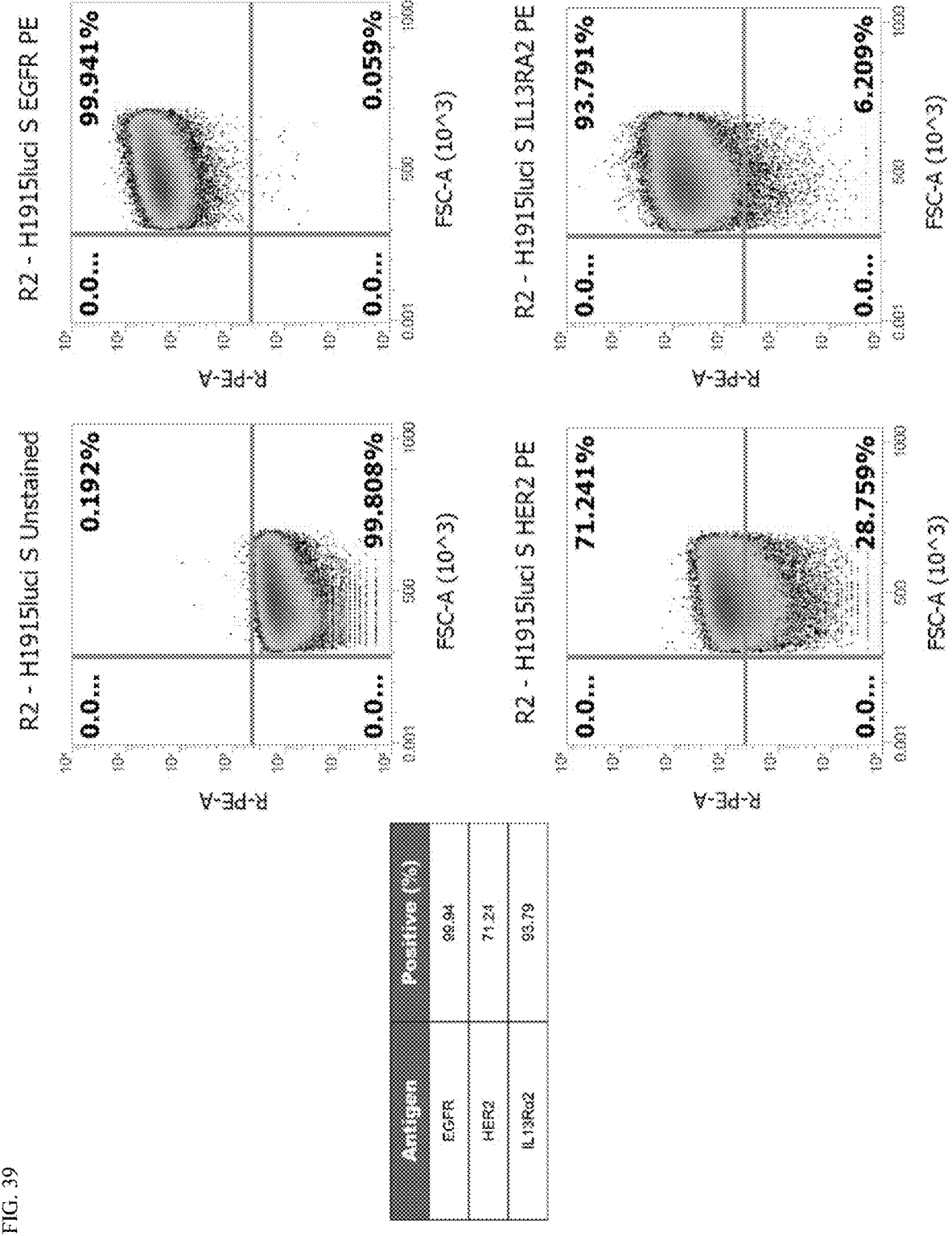
FIG. 39 shows EGFR, HER2 and IL13Rα2 expression levels in the brain metastatic NSCLC cell line H1915.

The abilities of the lead clone, SR26 CAR T cells, to continuously kill target cancer cells (serial killing) and to expand upon stimulation by target positive cancer cells were tested using serial incubation of the CAR T cells and cancer cells. It was found that the lead clone SR26 has strong serial killing activities and expands well (FIGS. 25 & 26).

Example 6. The Two-Armed BiTE CAR-T Cells Show Cytolytic Activity Against Different Type of Cancer Cells The two-armed BiTE CAR-T cells show a much stronger cytolytic activity to GBM cancer cells than one-armed counter BiTE CAR-T cells (see, e.g., FIGS. 20, 21 and 27-31B). Next, whether stronger cytolytic activities of the two-armed BiTE CAR-T cells apply to other types of cancer was investigated. Results of the real time cytolytic assay show that the two-armed BiTE CAR-T cells also confer stronger cytolytic activities than the one-armed BiTE CAR-T cells in other caner types, including HER2-positive breast cancer, lung cancer and brain metastatic lung cancer (FIGS. 32-39). By conferring cytolytic activities in various cancer types, the two-armed BiTE CAR-T cells may be widely applicable for treating many different cancers.

Figure 40A:
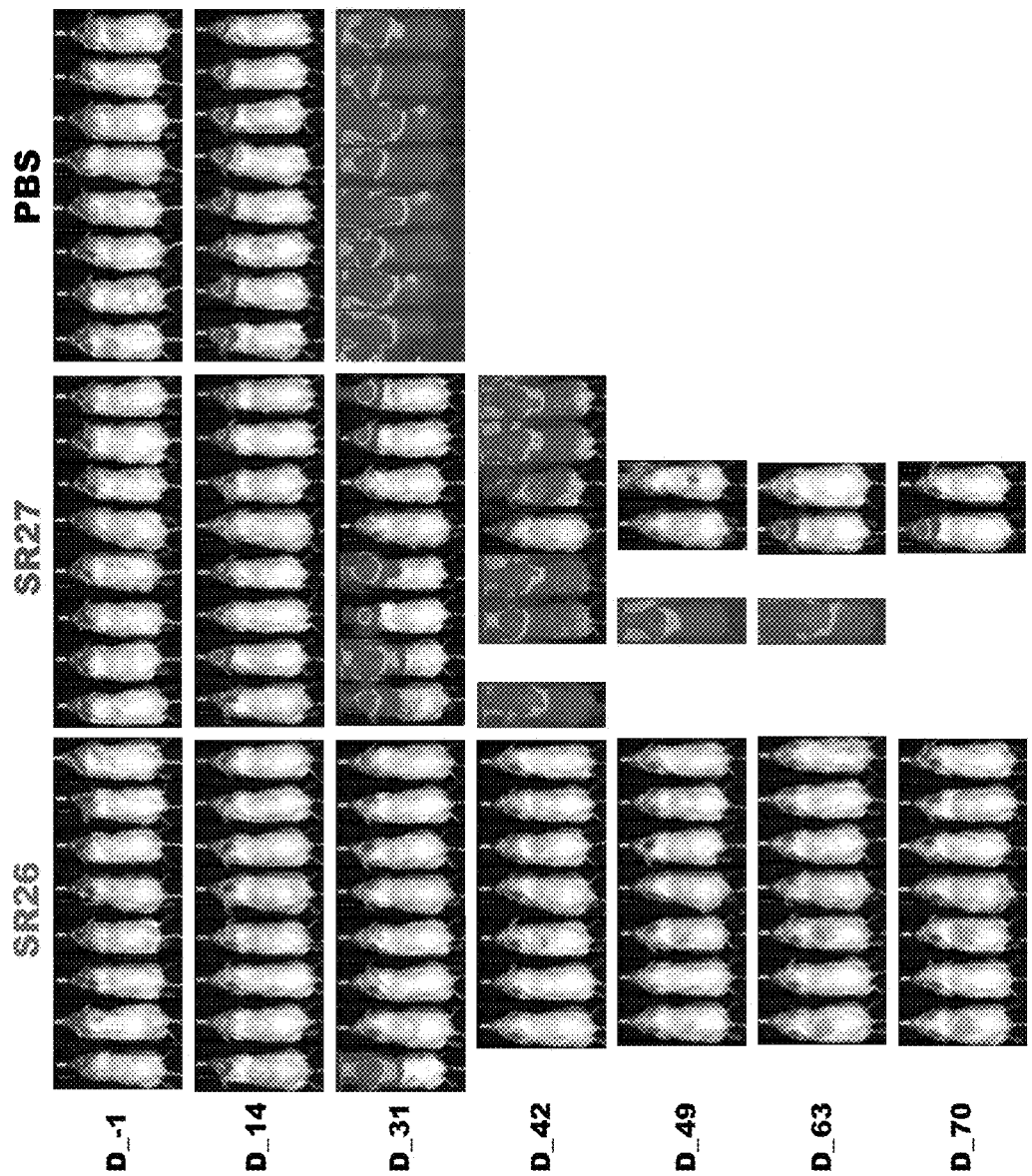
FIGS. 40A-C show therapeutic efficacies of SR26 in U87, one of the most malignant GBM models.
Figure 40B:
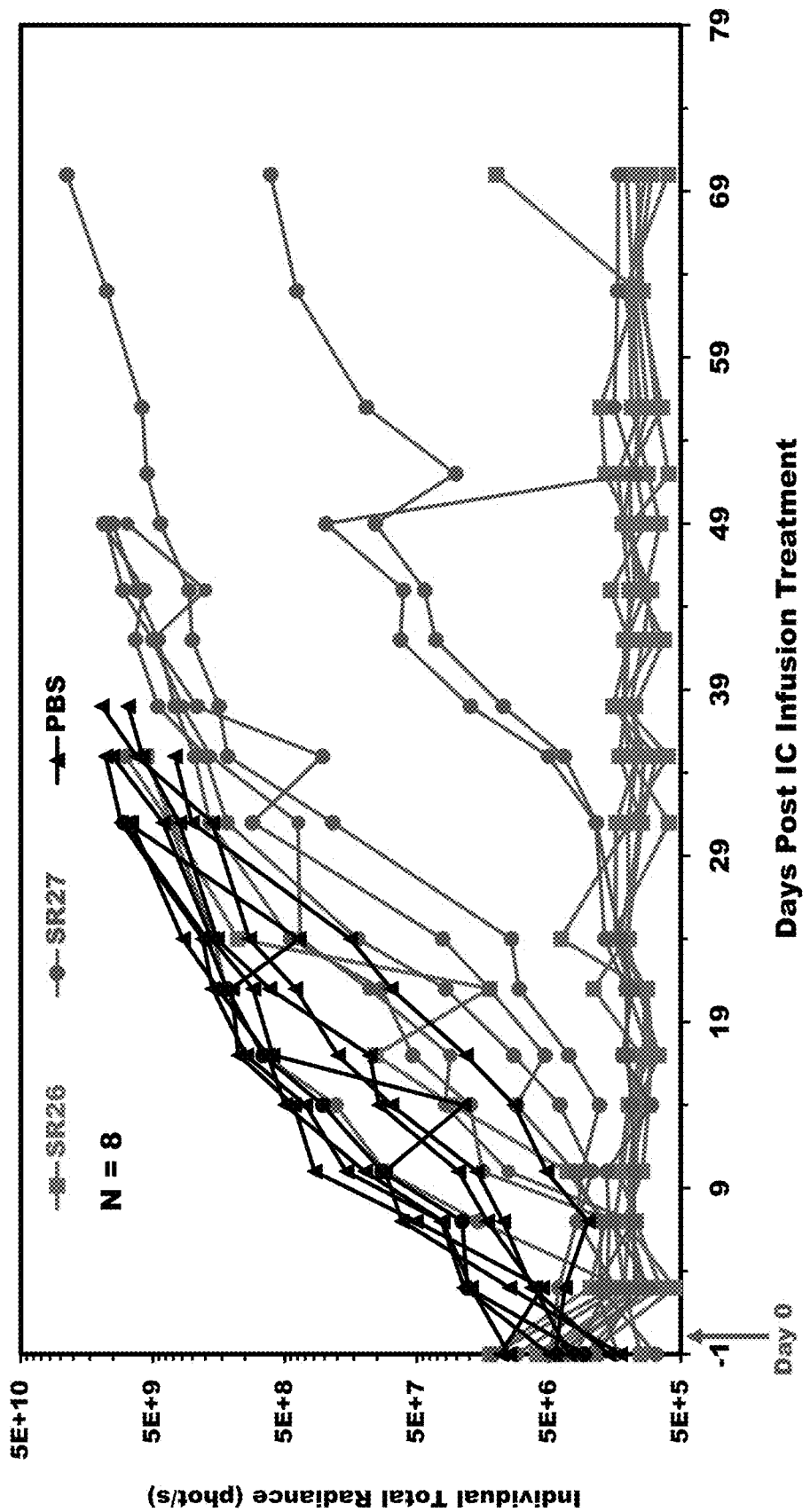
Figure 40C:
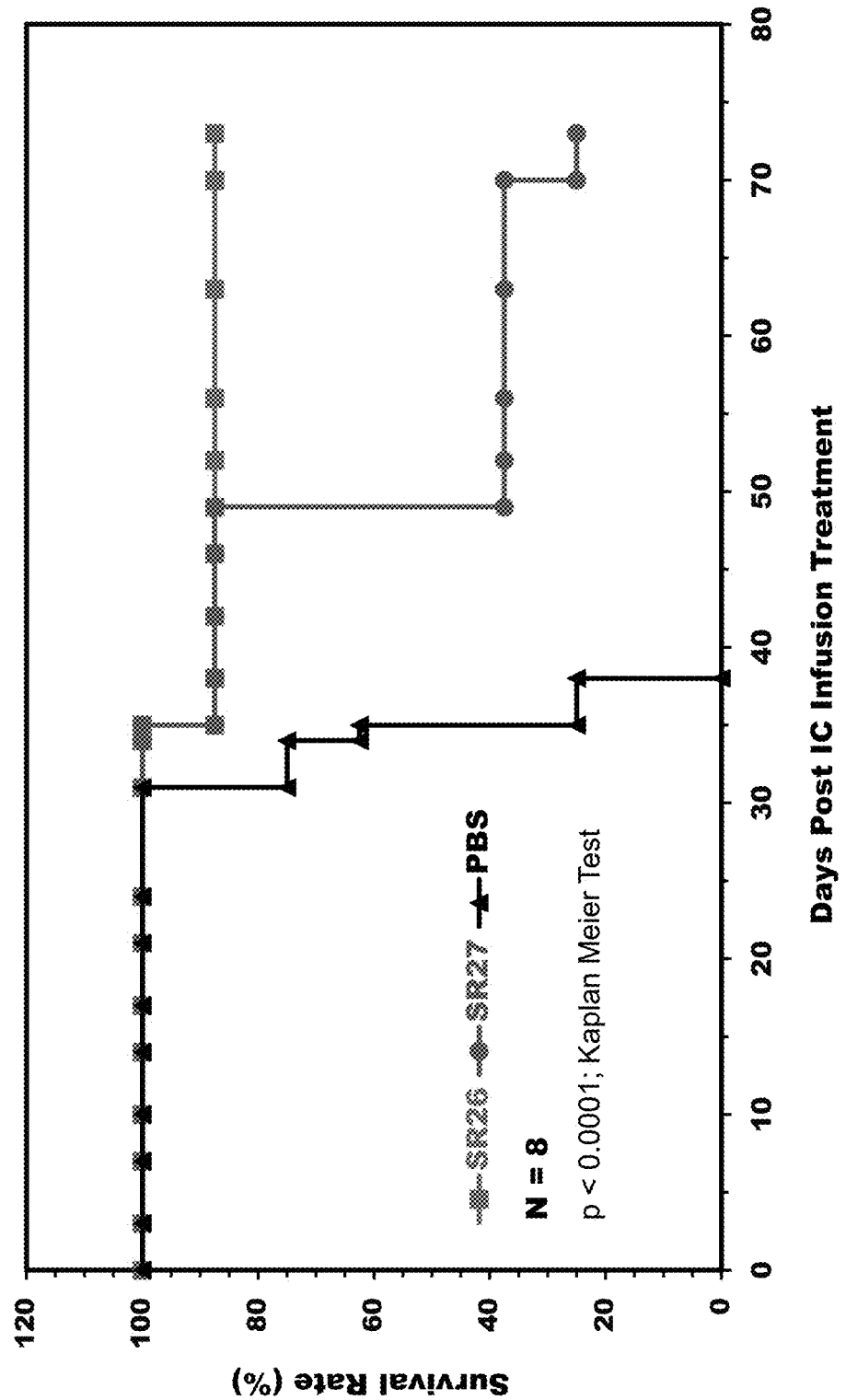

Example 7. The Two-Armed BiTE CAR-T Cells Show Therapeutic Efficacy in U87, a Highly Aggressive GBM Model To evaluate the in vivo pharmacological efficacy of SR26, a lead clone of the two-armed BiTE CAR-T cells, U87, one of the most malignant GBM intracranial GBM model was used. The results on tumor eradication and survival rate, as shown in FIGS. 40A-40C, demonstrate for the first time, this level of therapeutic efficacy in the authentic U87 GBM model at a sub-therapeutic dosage. SR26 has an unprecedented pre-clinical therapeutic efficacy for GBM.

Example 8. PK/Bio-Distribution and Toxicology Studies of SR26

Figure 41:
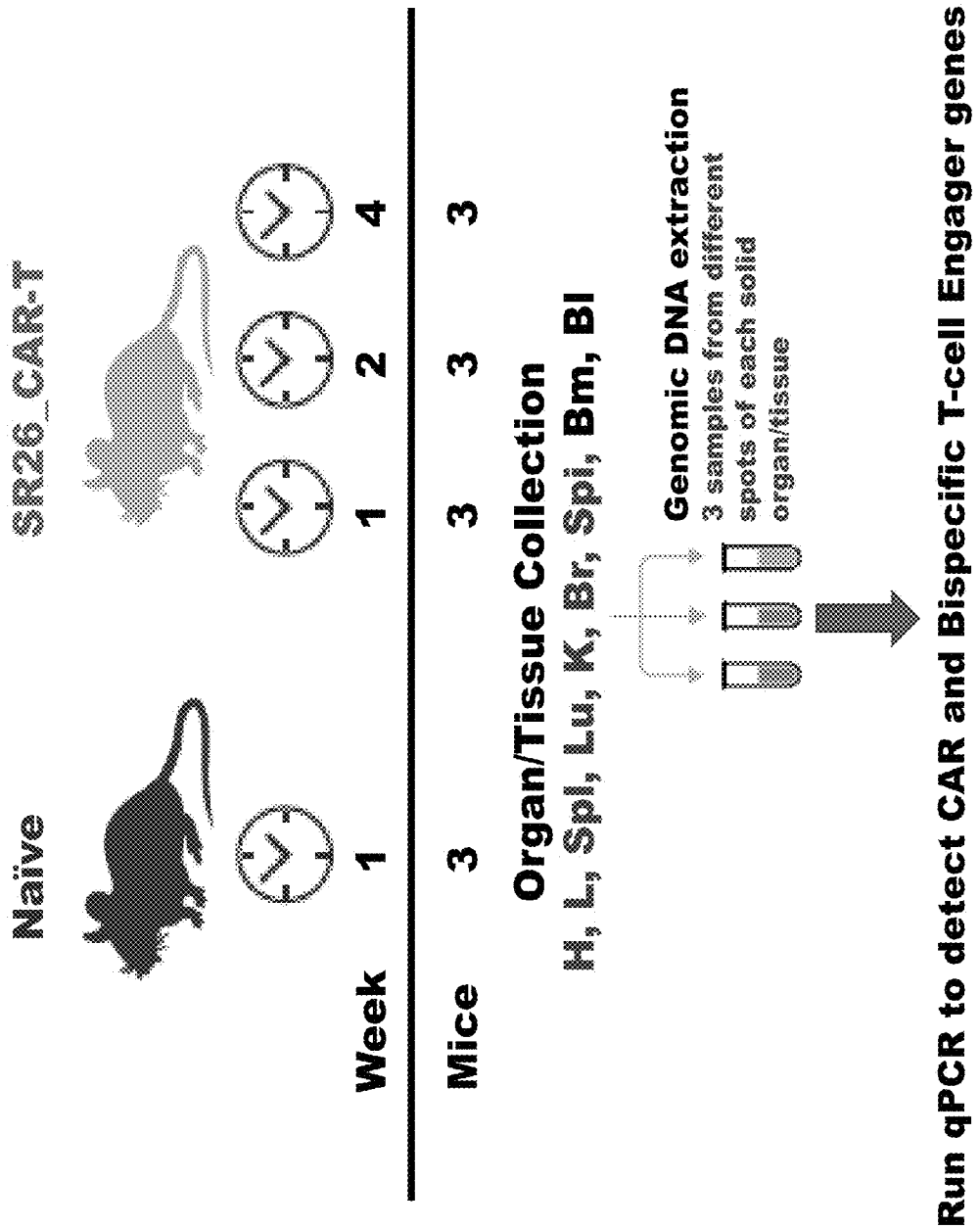
FIG. 41 depicts the workflow of the PK/Distribution study of SR26 (two-armed BiTE CAR-T cells) with the following abbreviations: H, heart; L, live; Spl, spleen; Lu, lung; K, kidney; Br, brain; Spi, spinal cord; Bm, bone marrow; Bl, blood.
Figure 42:
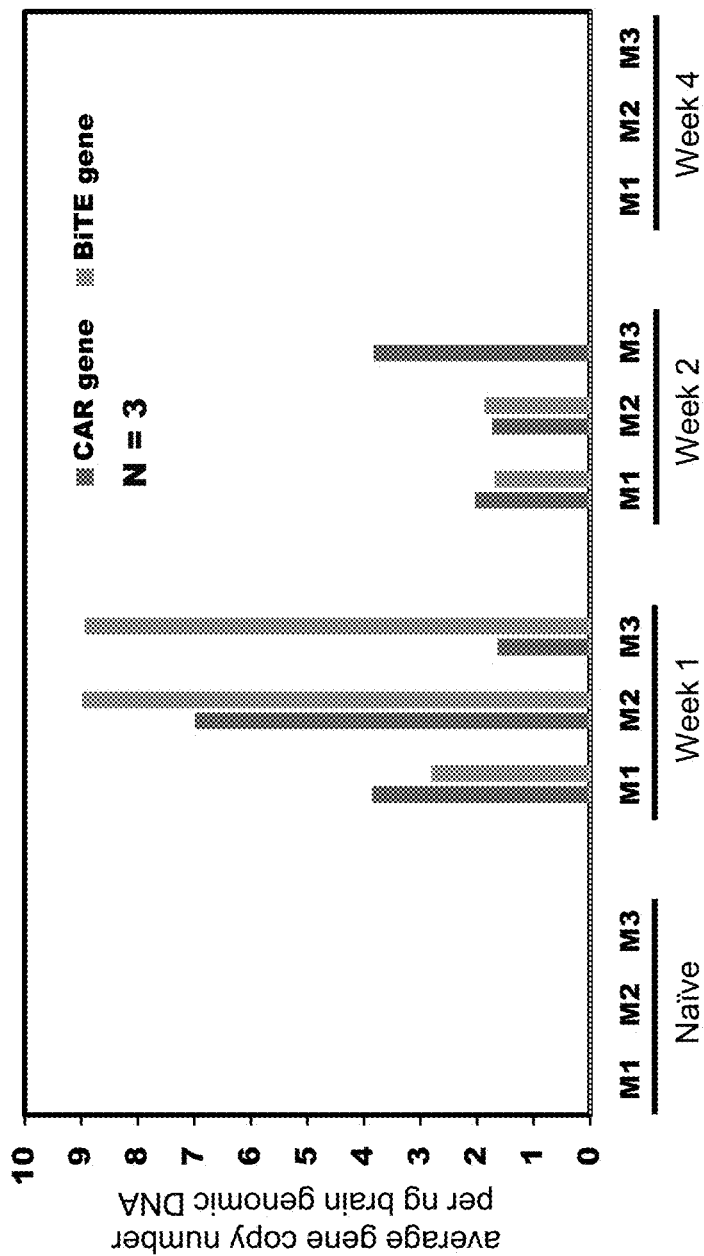
FIG. 42 shows PK/Distribution. Both CAR and BiTE genes were only detected in the brain, and not in the genomic DNA of the heart, liver, spleen, lung, kidney, bone marrow, spine cord or blood, suggesting that the infused CAR-T cells are restricted in the brain. The CAR-T cells penetrated into the brain tissue, and the penetrated CAR-T cells gradually lost viability or re-entered quiescent state due to a lack of related tumor antigen stimulation in the GBM-free mice. M1: mouse #1; M2: mouse #2; M3: mouse #3.

PK studies were performed to evaluate the in vivo pharmacokinetics/bio-distribution of SR26. Both the CAR gene and the BiTE gene were only detected in the brain. Neither was detectable in the genomic DNA of the heart, liver, spleen, lung, kidney, bone marrow, spine cord or blood. The data suggest that the infused CAR-T cells were restricted to the brain. The CAR-T cells can penetrate brain tissue, and the penetrated CAR-T cells gradually lose viability or re-enter the quiescent state due to a lack of related tumor antigen stimulation in the GBM free mice (FIGS. 41 and 42).

Figure 43:
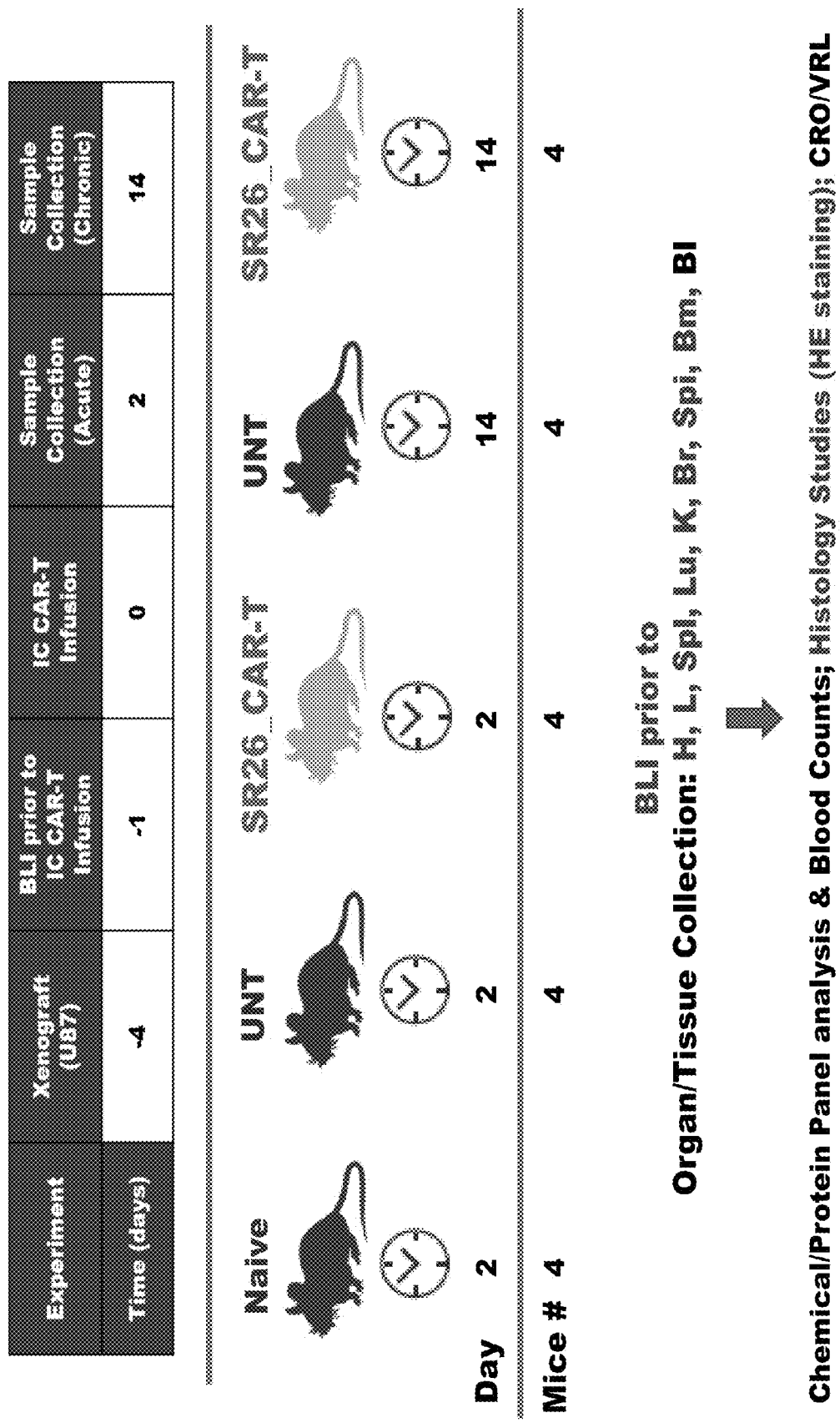
FIG. 43 depicts the toxicology study schedule and workflow with the following abbreviations: H, heart; L, live; Spl, spleen; Lu, lung; K, kidney; Br, brain; Spi, spinal cord; Bm, bone marrow; Bl, blood. UNT, un-treated.
Figure 44A:
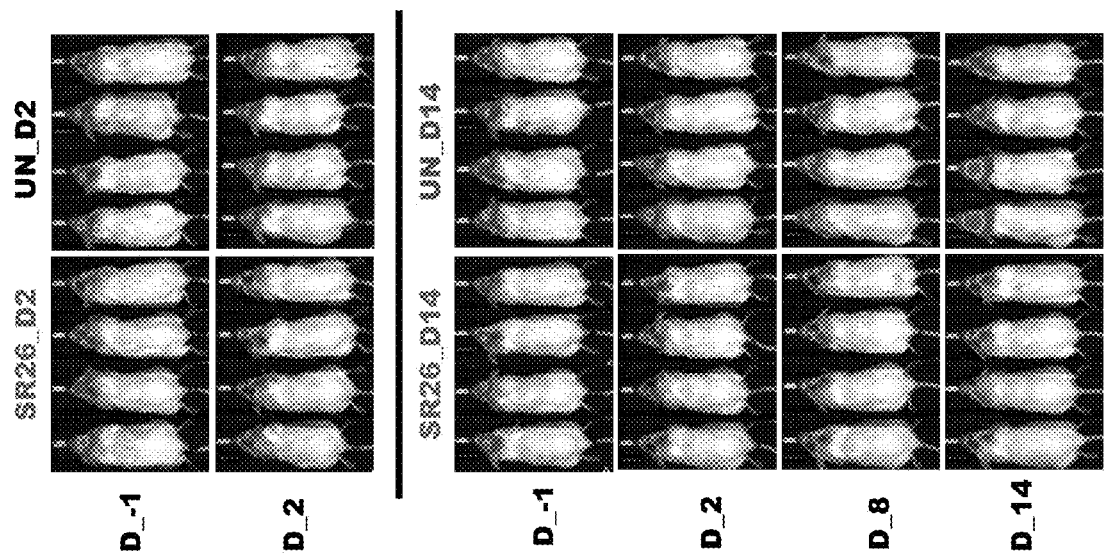
FIGS. 44A-B show therapeutic efficacies of SR26 in U87, one of the most malignant GBM models.
Figure 44B:
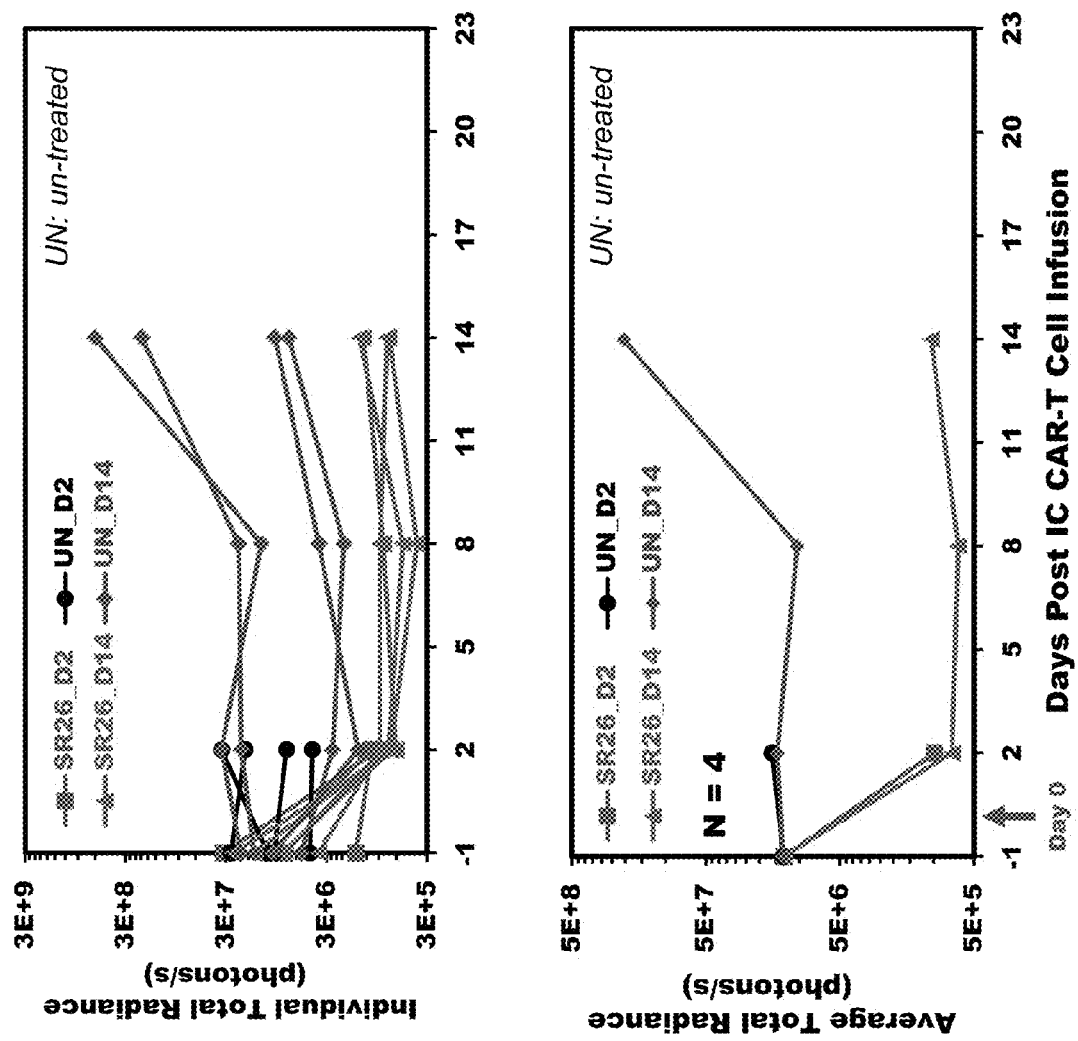
Figure 46:
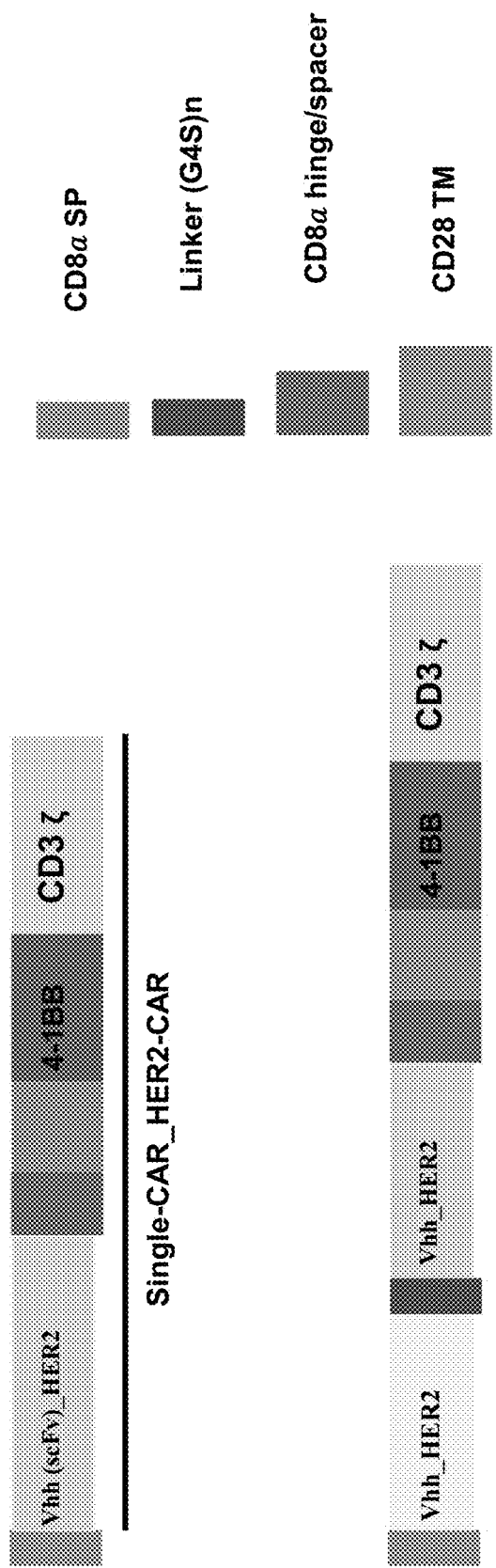
FIG. 46 is a graphic representation of a non-limiting example of HER2 CARs.

Next, toxicology studies were performed to evaluate potential in vivo toxicity of SR26. The results show that SR26 can efficiently eradicate GBM tumors, and no abnormal effects were observed in SR26-treated mice under both acute (day 2) and chronic (day 14) conditions (FIGS. 43-45).

Example 9. Second Generation BiTE-Armed CAR-T Therapy for GBM

Figure 47:
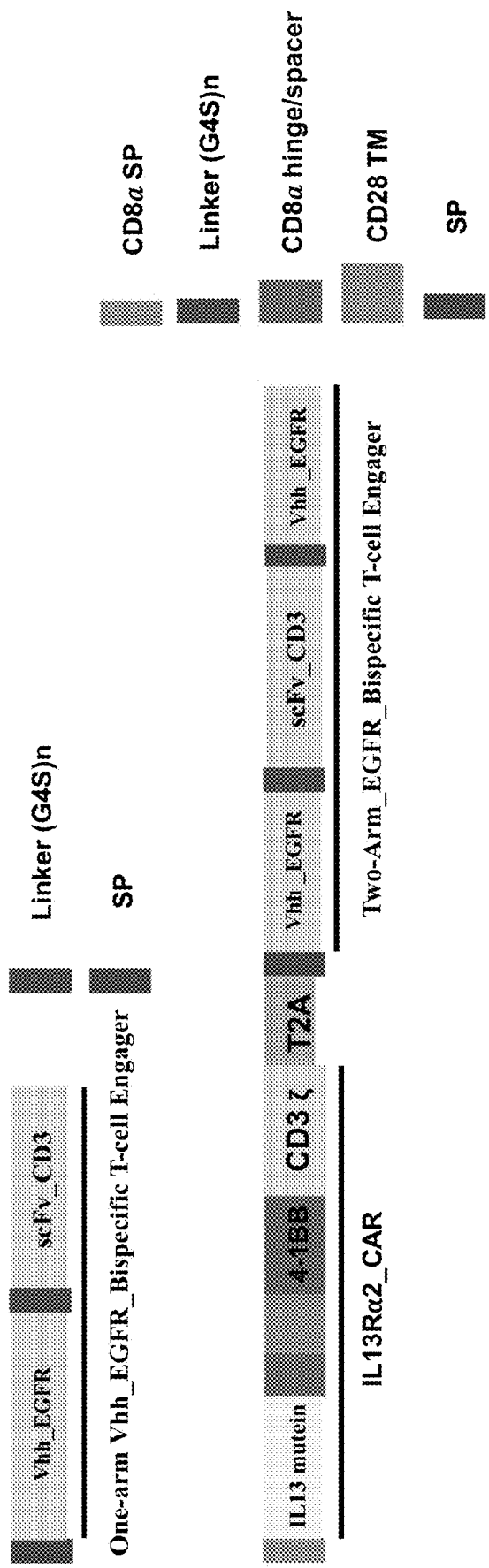
FIG. 47 are graphic representations of non-limiting examples of one-arm Vhh_EGFR_BiTEs (top), and two-arm Vhh_EGFR_BiTEs combined with IL13Rα2 CAR (bottom).
Figure 48:
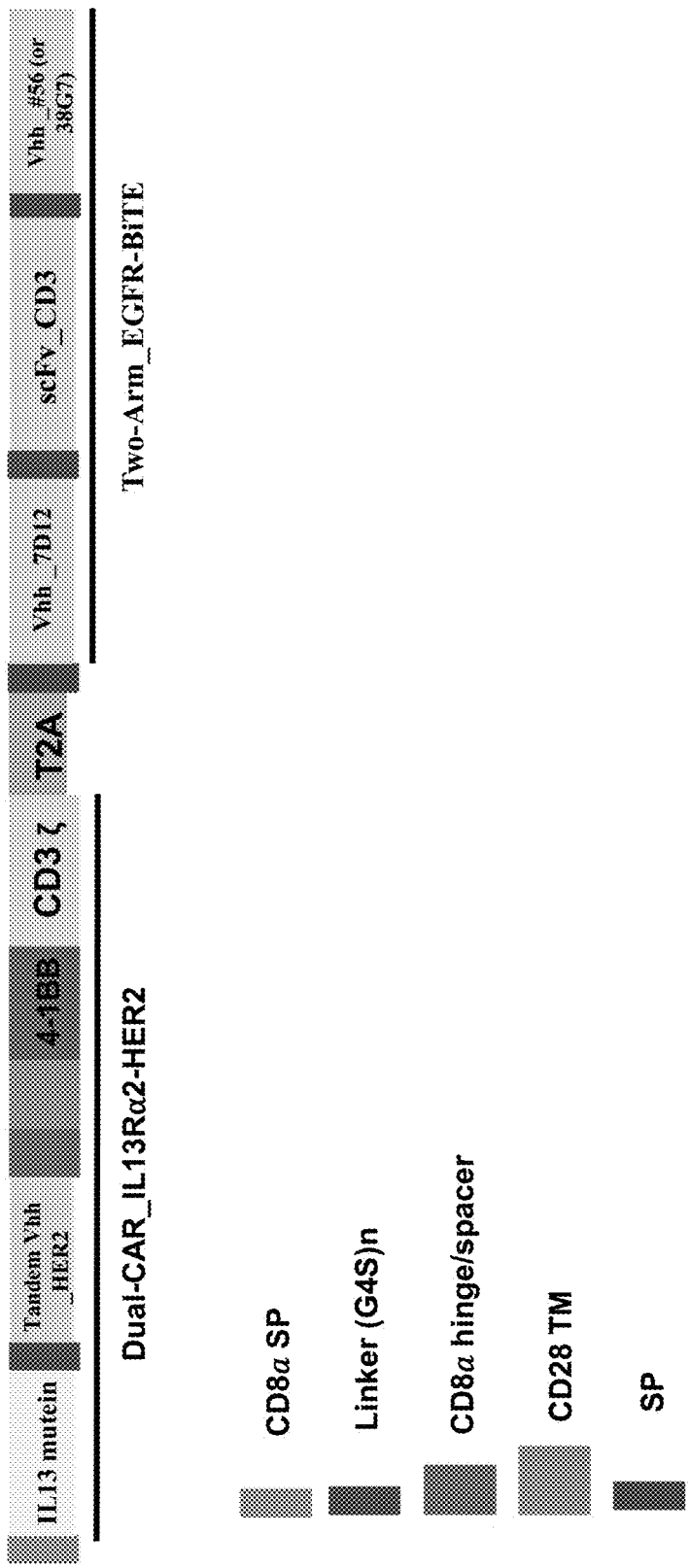
FIG. 48 is a graphic representation of a non-limiting example of two-Arm_EGFR_BiTE armed dual-CAR-Ts.
Figure 49:
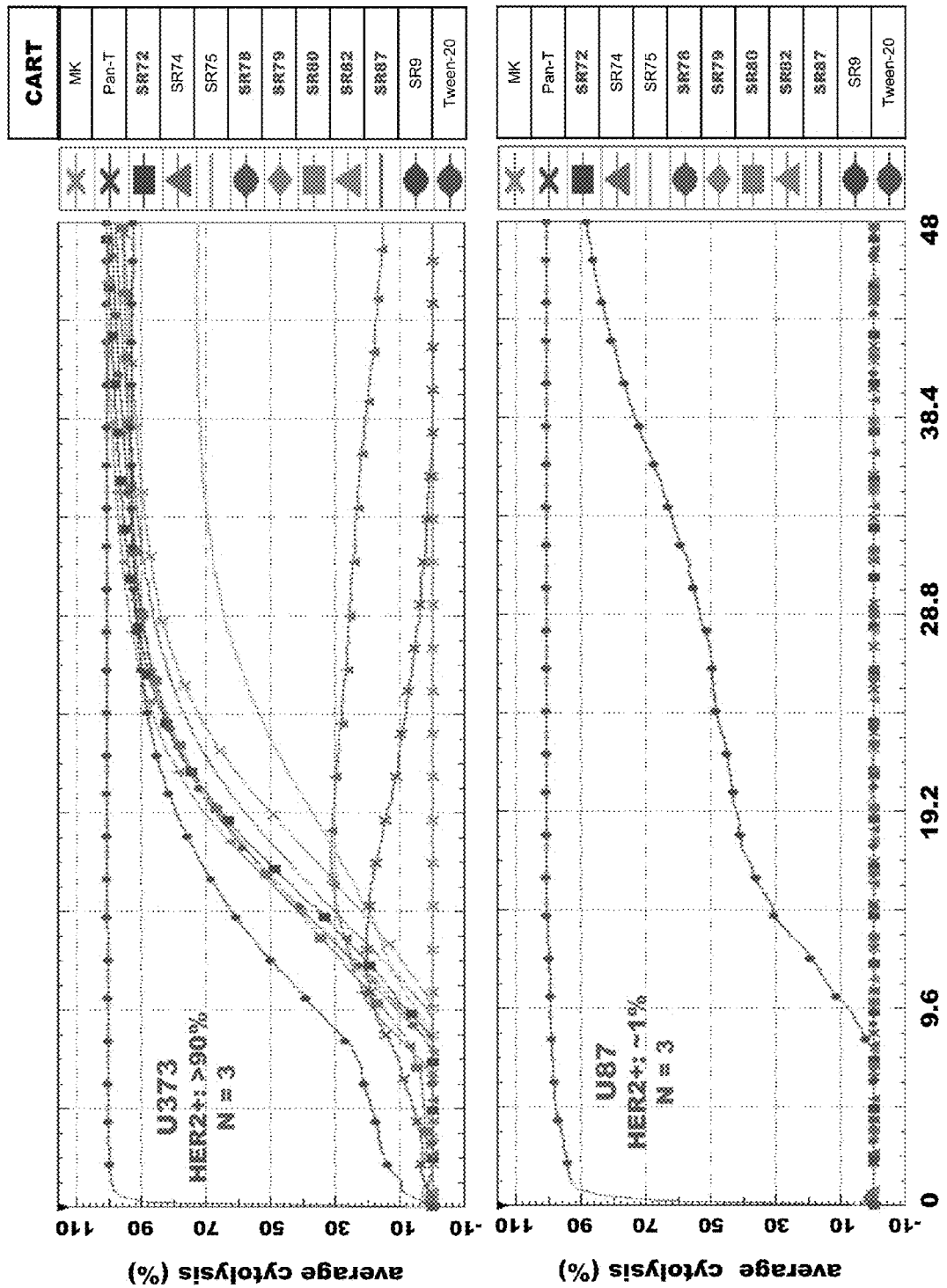
FIG. 49 shows results of an RTCA-based killing assay. After two rounds of CAR-T functional screening, six lead anti-HER2 Vhh nanobody clones (SR72, SR78-SR80, SR82 and SR87) were identified from 39 in-house developed candidates. The data each is the average of three parallel second round repeats of the RTCA assay. The E/T=1/2; the pan T cells were from Healthy Donor 2; SR9, a dual CAR-T targeting both HER2 and IL13Rα2, was used as a positive control; the IL13Rα2 are positive in both U87 (45%) and U373 (42%).
Figure 50:
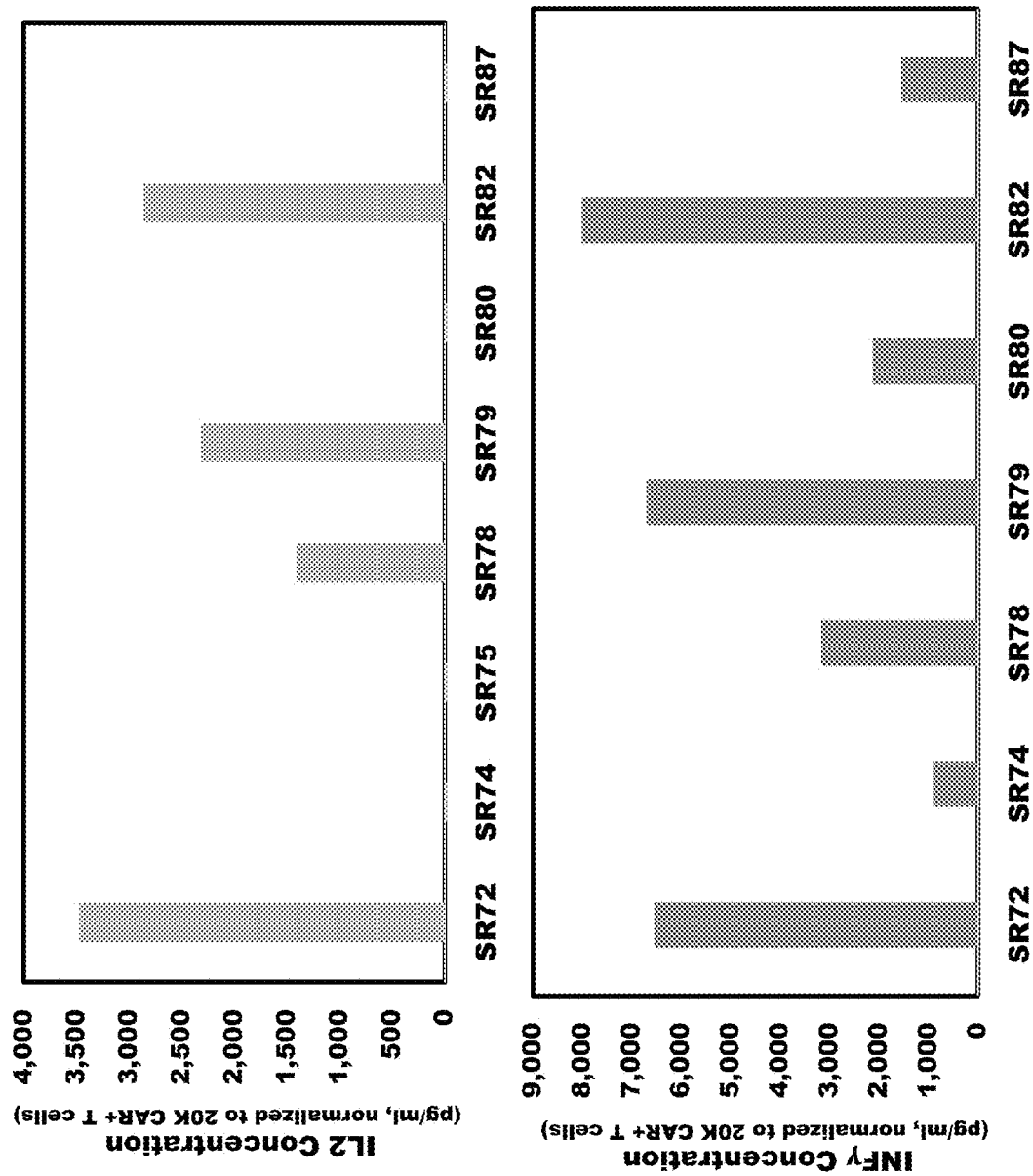
FIG. 50 shows quantitative results of cytokine release. After two rounds of CAR-T killing capability assay screening, lead anti-HER2 Vhh nanobody clones were further validated by quantifying the cytokine release. The data each is the average of six parallel repeats of the CAR-T treated GBM cancer cell line U373. The E/T=1/8; the pan T cells were from Healthy Donor 2. Combining with cytolysis activity with the capacity to induce cytokine release, the lead clones were further narrowed to SR72, SR78, SR79 and SR82.
Figure 51:
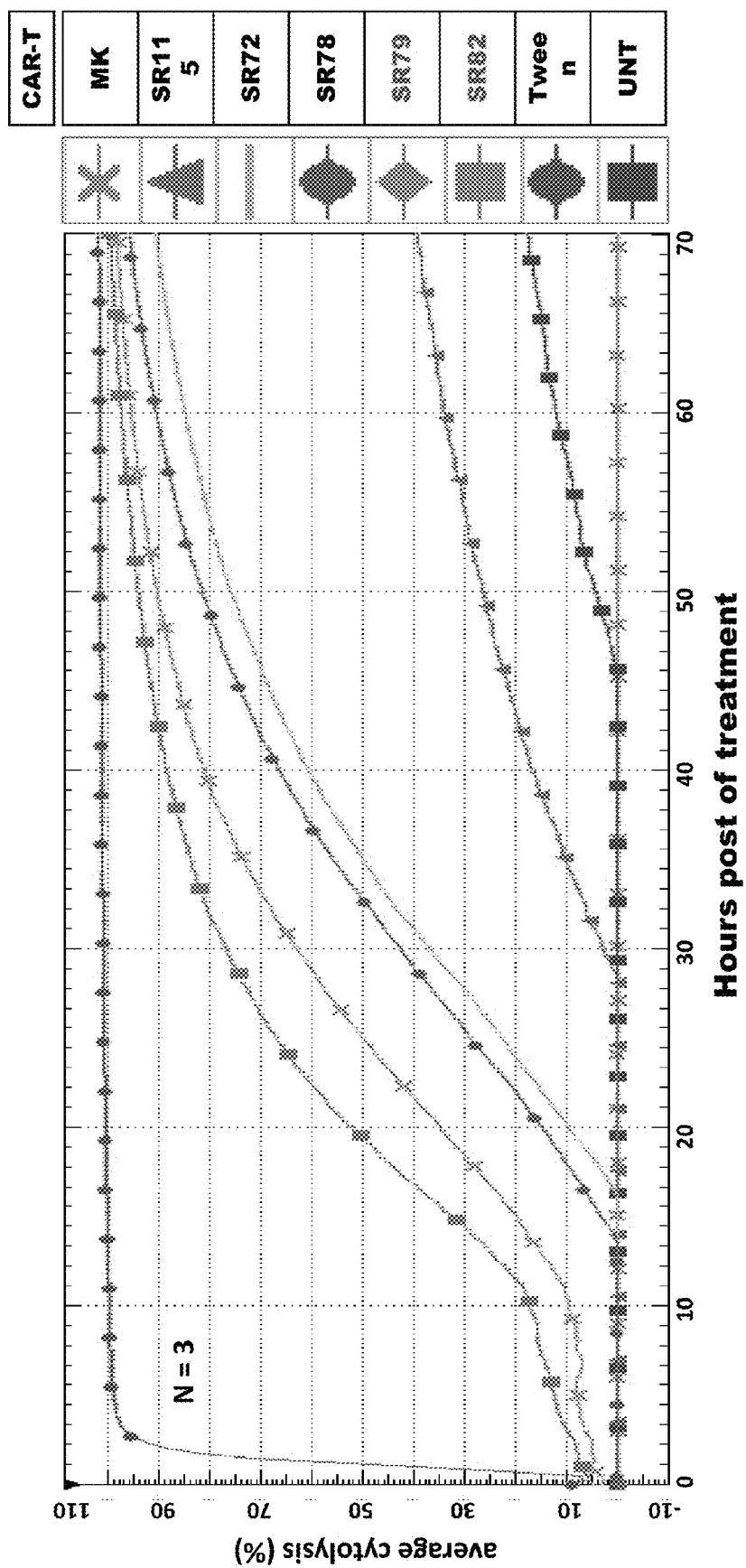
FIG. 51 shows results of an RTCA-based killing assay for further validating the anti-HER2 Vhh nanobody lead clones (SR72, SR78-80, SR82 and SR87). The breast cancer cell line MCF-7 with lower HER2 expression was used as the target cell. The data each is the average of three parallel repeats of the RTCA assay. The E/T=1/8; the pan T cells were from Healthy Donor 2; SR115, trastuzumab scFv CAR-T, was used as a control.
Figure 52A:
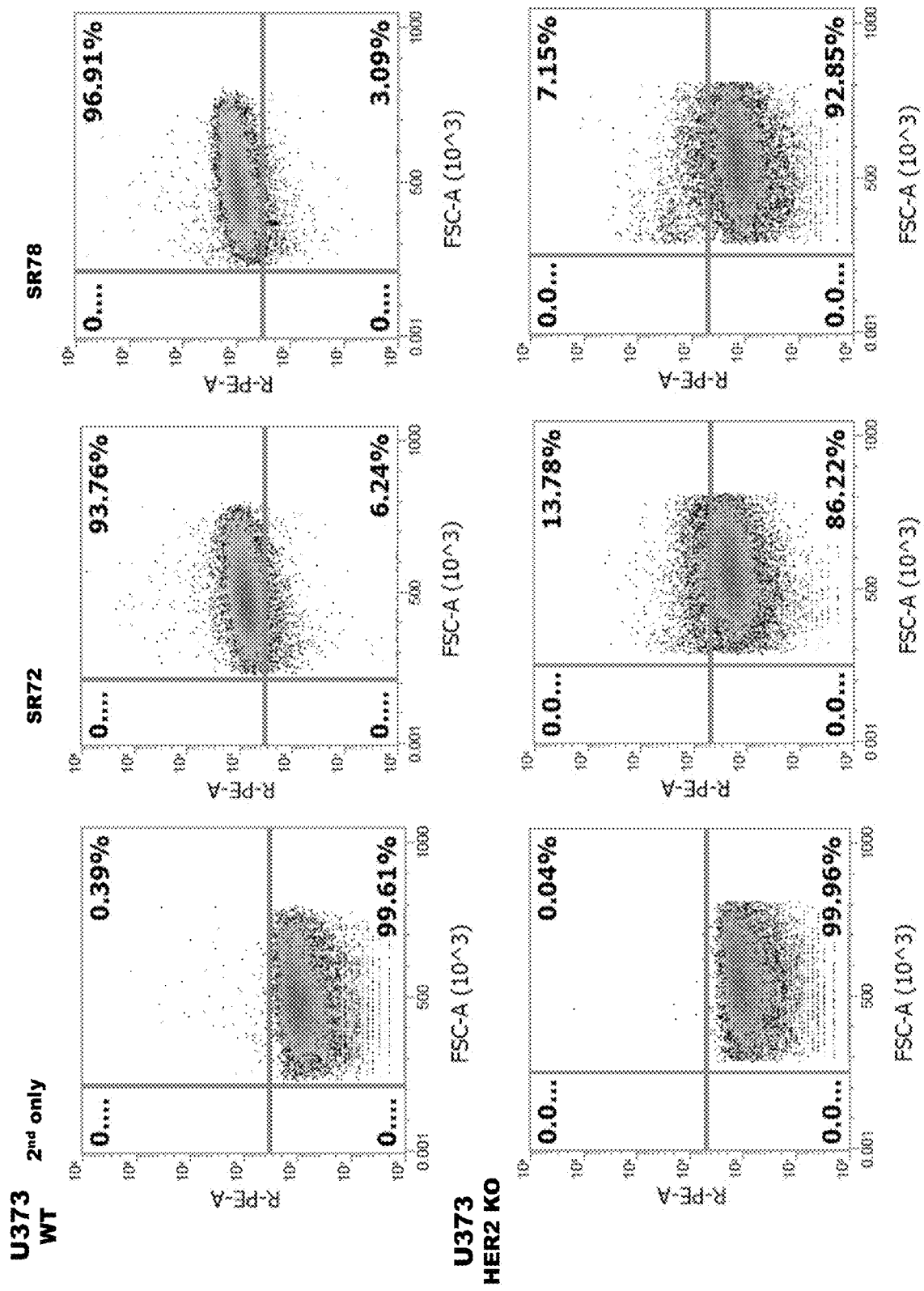
Figure 52C:
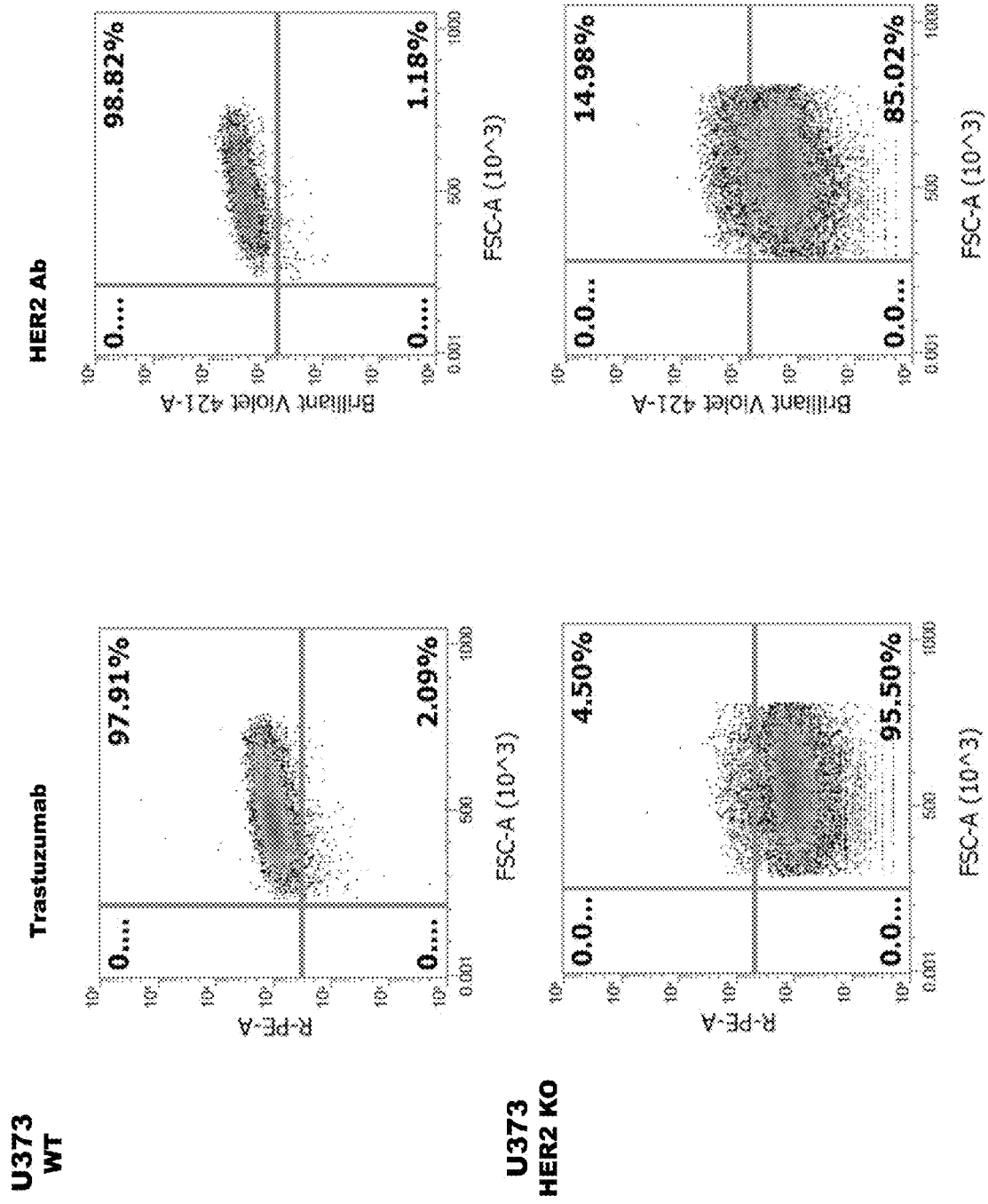
Figure 53A:
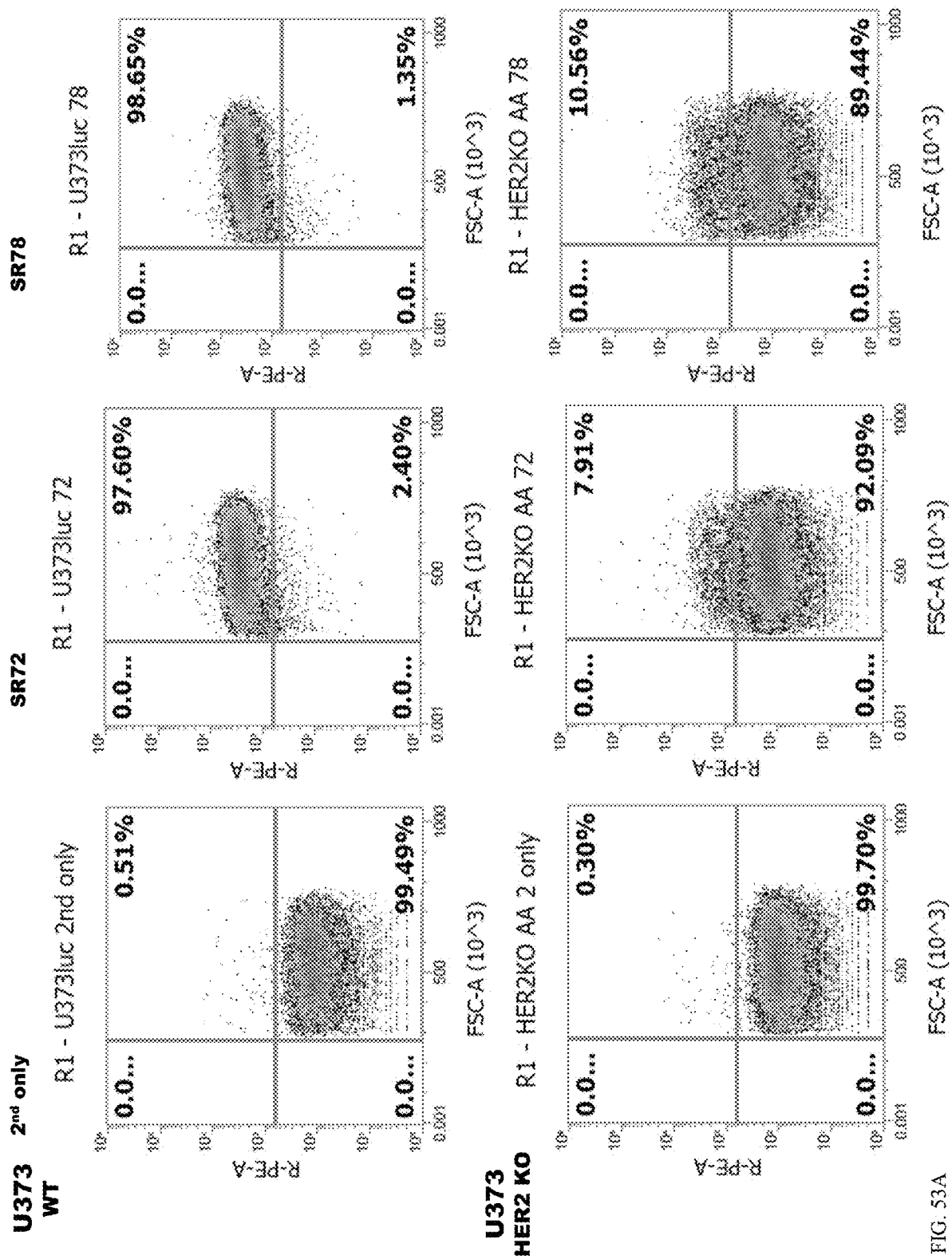
Figure 54A:
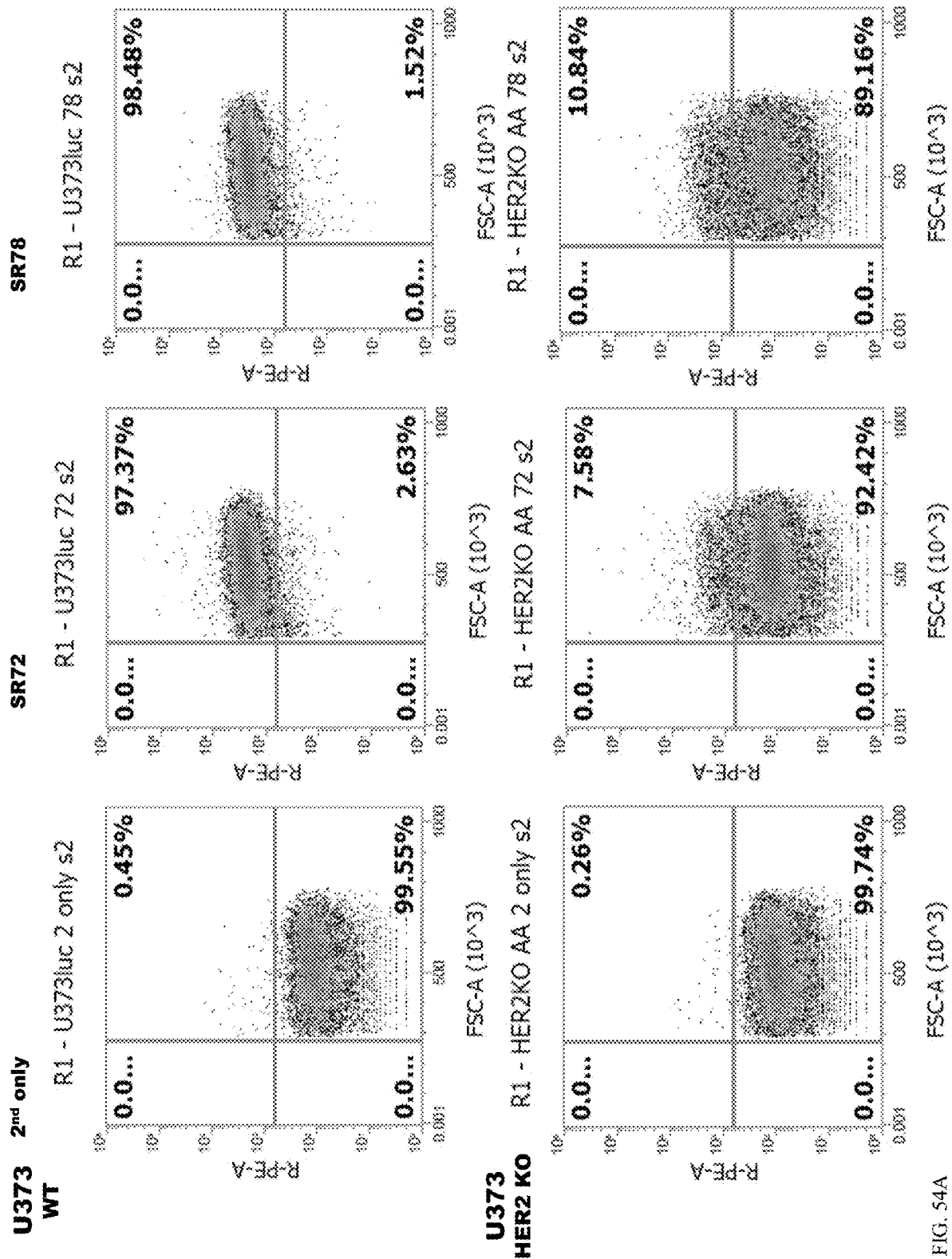
Figure 55:
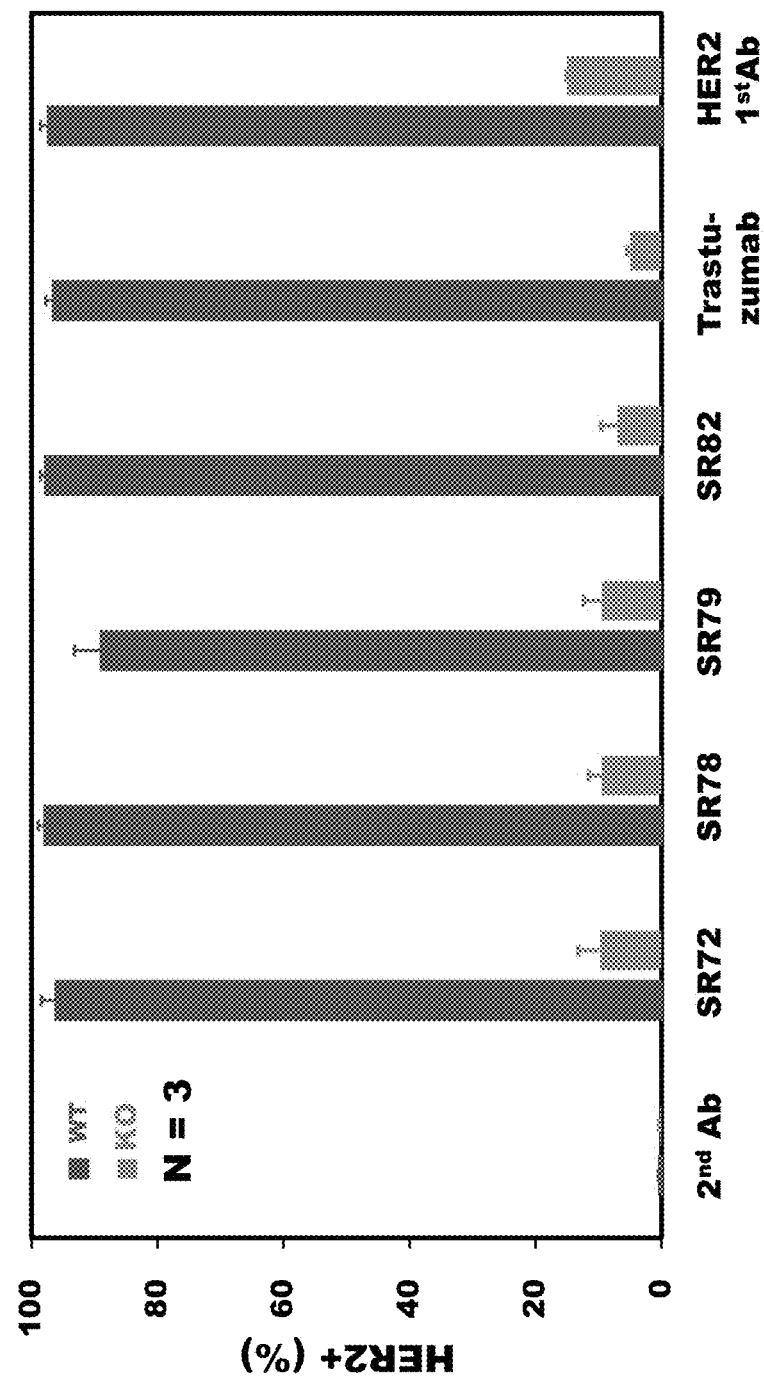
FIG. 55 summarizes results of studies, shown in FIGS. 52A-54E, of the anti-HER2 Vhh nanobody lead clones (SR72, SR78-80, SR82 and SR87) with the following abbreviations: WT: wild-type GBM cancer cell line U373; KO: HER2 knockout U373 cell line.
Figure 57:
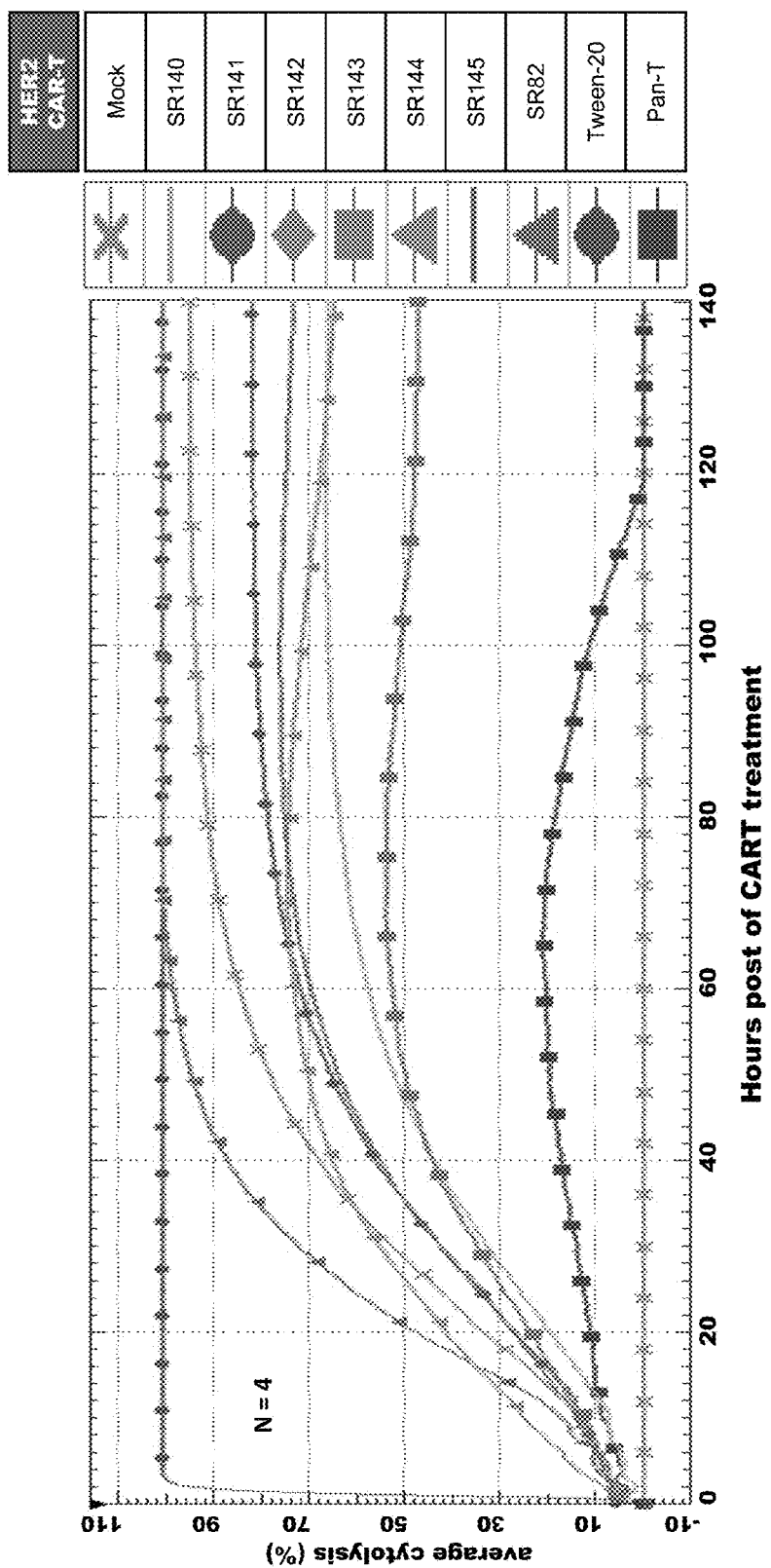
FIG. 57 shows results of RTCA-based killing assay. The RTCA-based CAR-T killing activity assay showed that SR142 is the top clone of tandem HER2 Vhh CAR-T; the single Vhh HER2 CAR-T SR82 still has compelling killing activity when compared to those tandem CAR-T cells. The breast cancer cell line MCF-7 with lower HER2 expression was used as the target cell. The data each is the average of four parallel repeats of the RTCA assay. The E/T=1/8; the pan T cells were from Healthy Donor 2.
Figure 58:
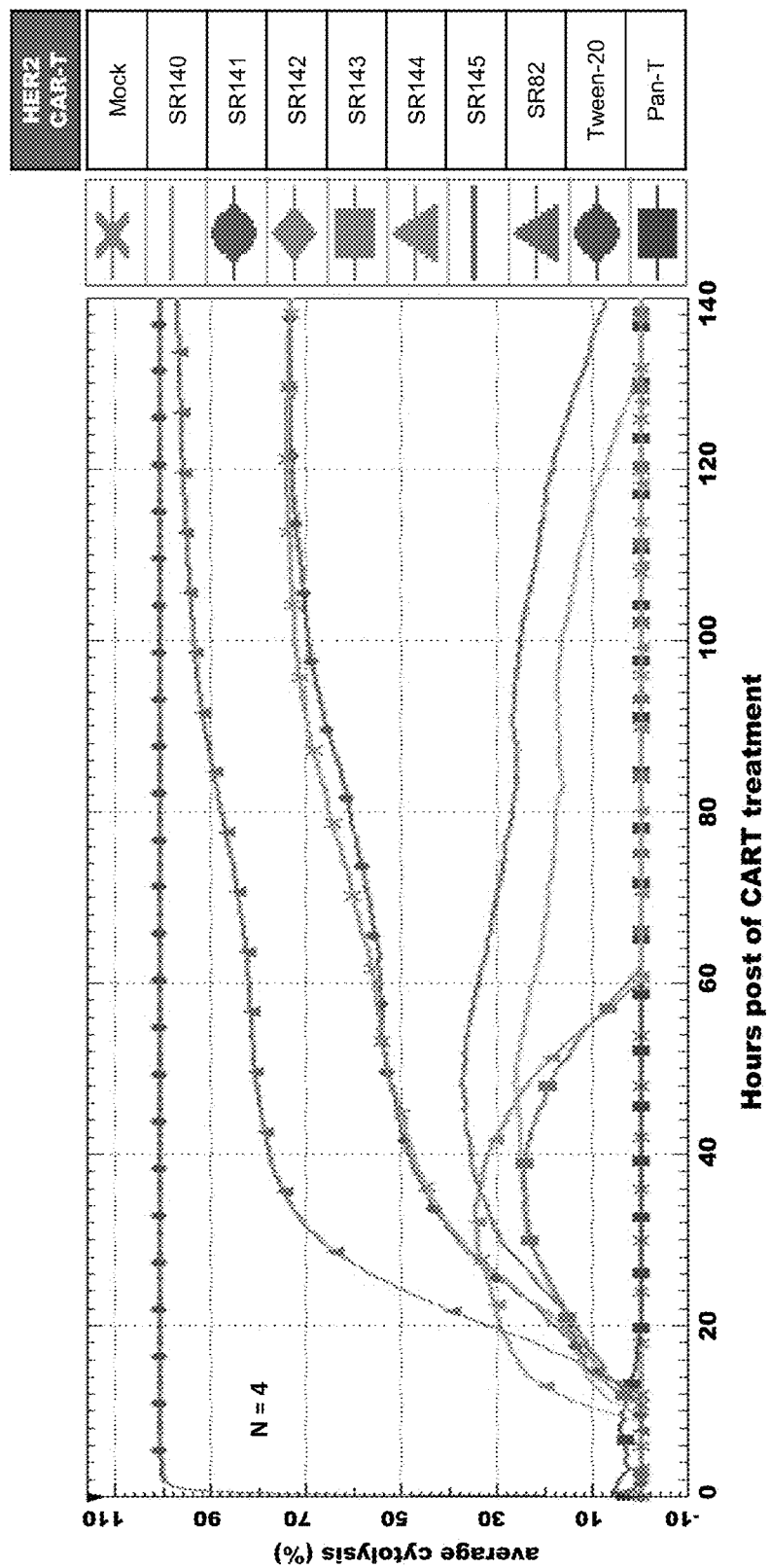
FIG. 58 shows results of an RTCA-based killing assay. The RTCA-based CAR-T killing activity assay showed that SR141 and SR142 are the top clones of tandem HER2 Vhh CAR-T; the single Vhh HER2 CAR-T SR82 has compelling killing activity when compared to those tandem CAR-T cells. The GBM cell line U373 was used as the target cell. The data each is the average of four parallel repeats of the RTCA assay. The E/T=1/8; the pan T cells were from Healthy Donor 2.
Figure 59:
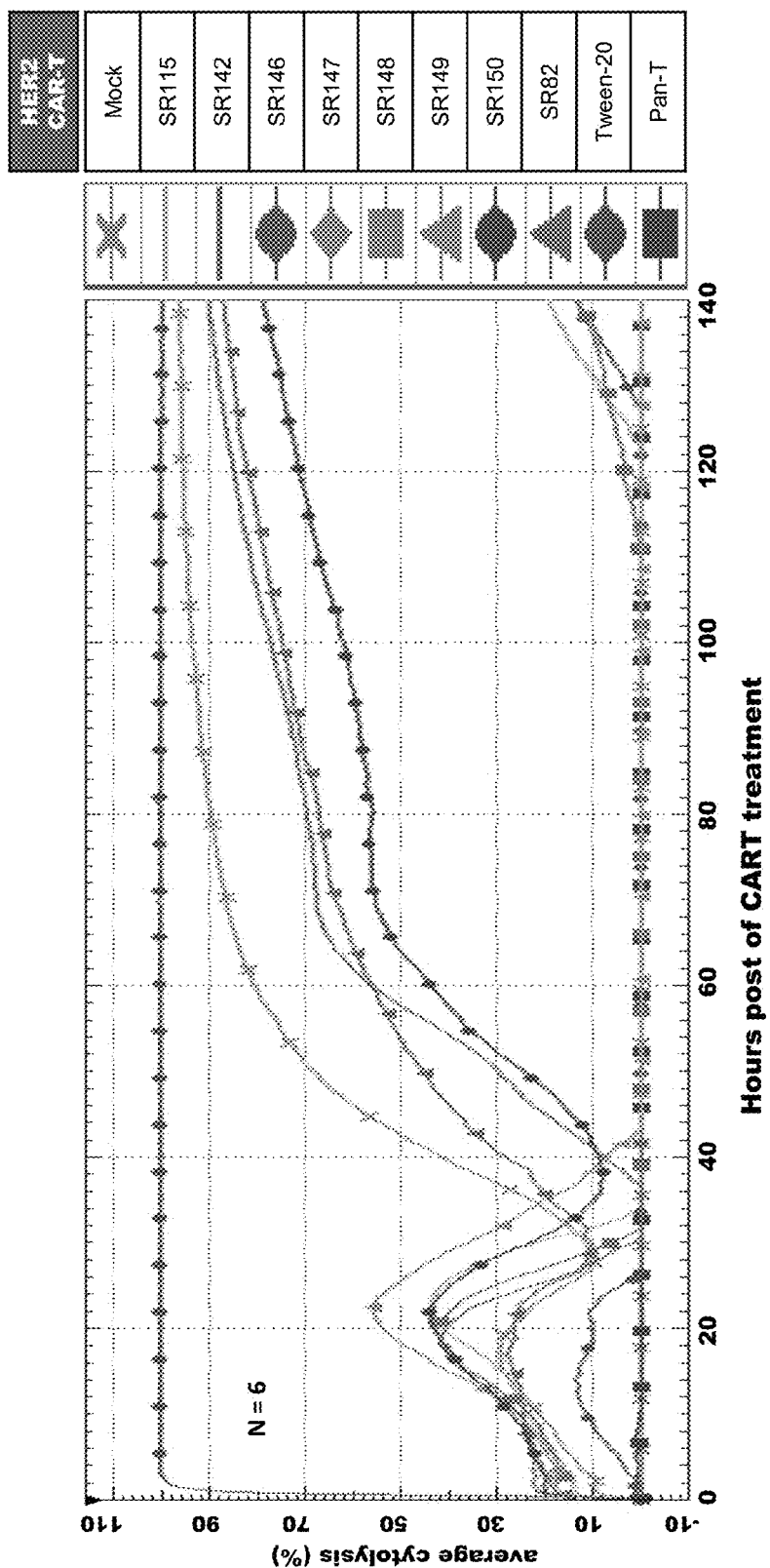
FIG. 59 shows results of an RTCA-based killing assay. The RTCA-based CAR-T killing activity assay showed that SR147 is the lead clone of tandem HER2 Vhh CAR-Ts. The breast cancer cell line A431 was used as the target cell. The data each is the average of 6 parallel repeats of the RTCA assay. The E/T=1/8; the pan T cells were from Healthy Donor 2.
Figure 60:
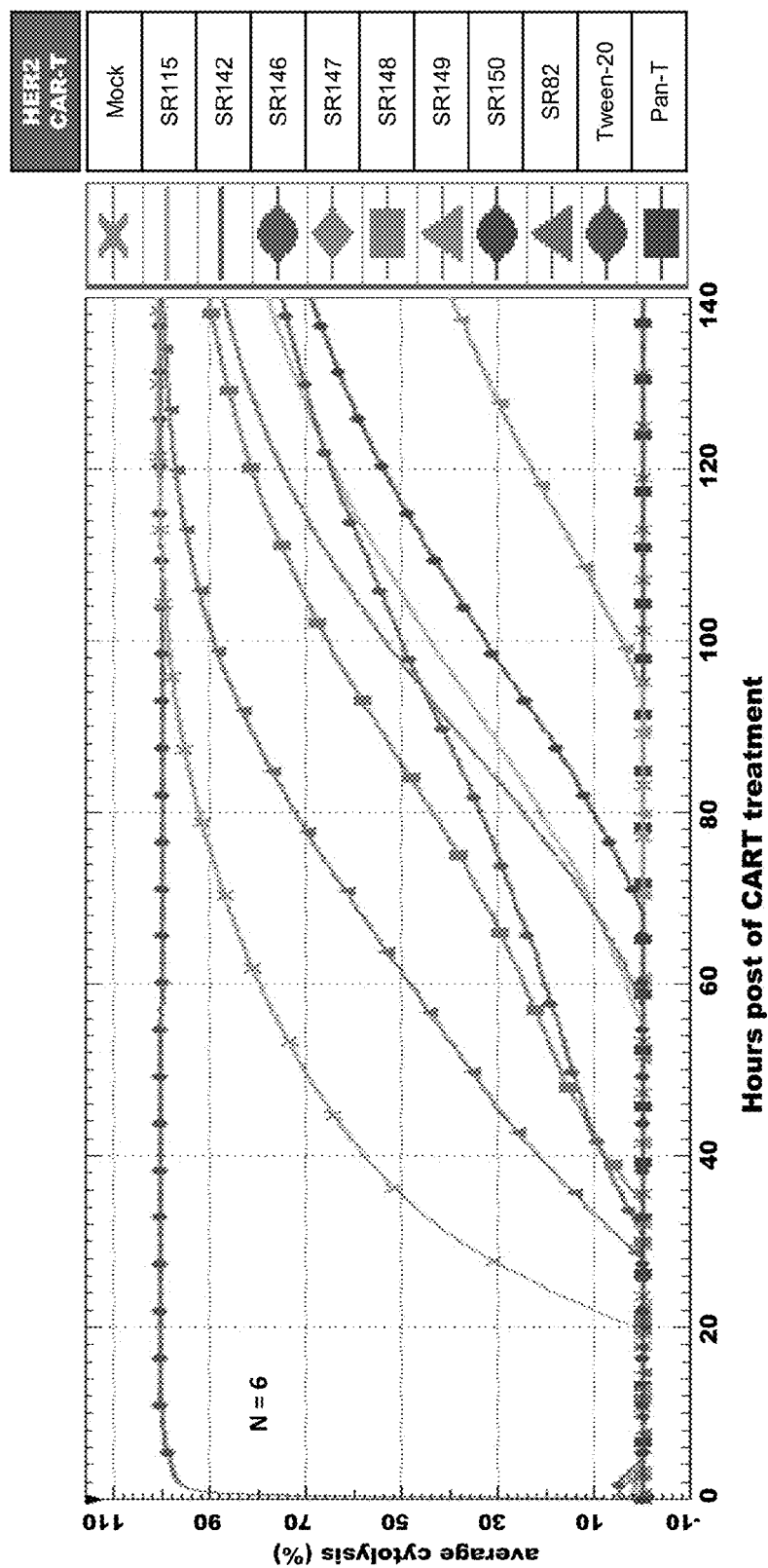
FIG. 60 shows results of RTCA-based killing assay. The RTCA-based CAR-T killing activity assay showed that SR147 is the lead clone of tandem HER2 Vhh CAR-Ts. The breast cancer cell line BT474 was used as the target cell. The data each is the average of six parallel repeats of the RTCA assay. The E/T=1/8; the pan T cells were from Healthy Donor 2.
Figure 61:
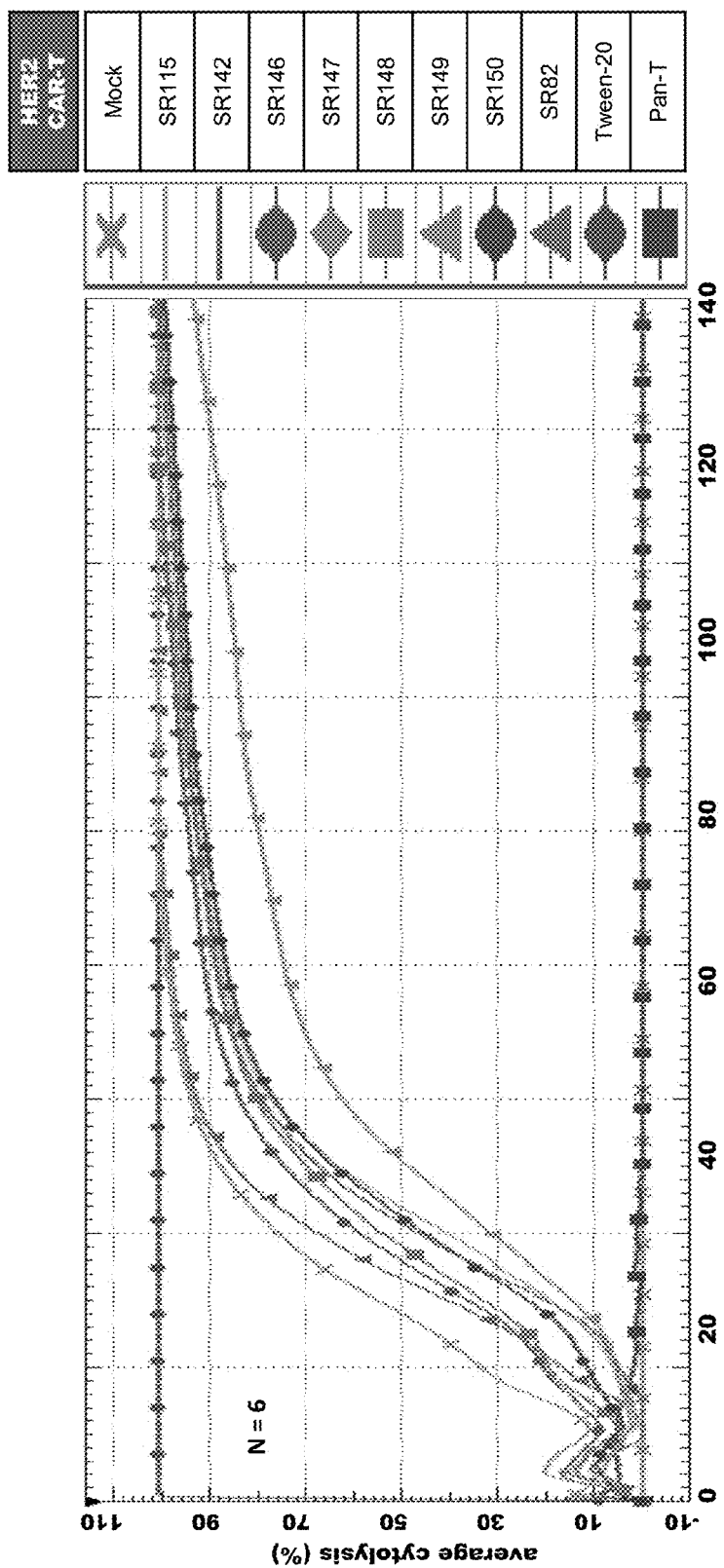
FIG. 61 shows results of an RTCA-based killing assay. The RTCA-based CAR-T killing activity assay showed that SR147 is the lead clone of tandem HER2 Vhh CAR-Ts. The NSCLC cell line H1944 was used as the target cell. The data each is the average of six parallel repeats of the RTCA assay. The E/T=1/16; the pan T cells were from Healthy Donor 2.
Figure 62:
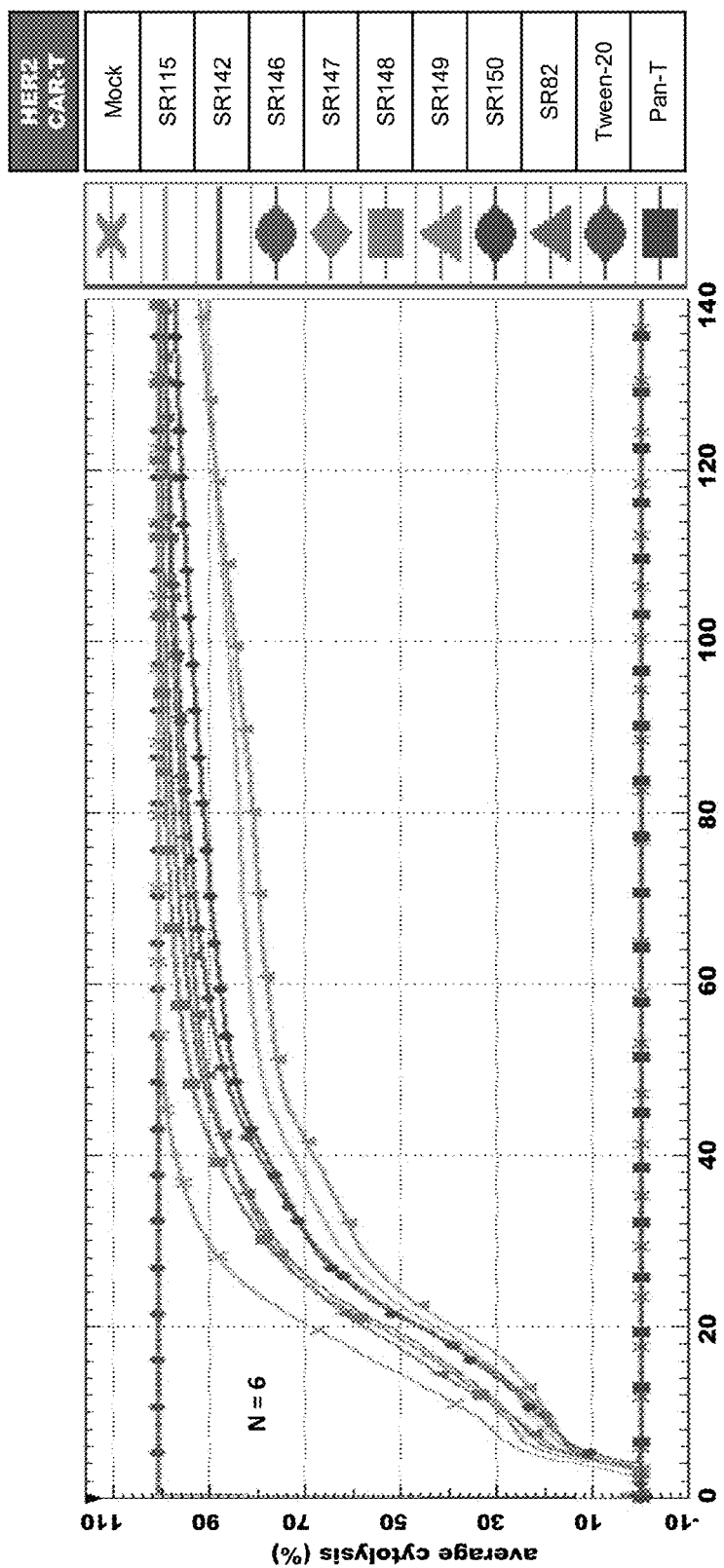
FIG. 62 shows results of an RTCA-based killing assay. The RTCA-based CAR-T killing activity assay showed that SR147 is the lead clone of tandem HER2 Vhh CAR-Ts. The GBM cancer cell line U251 was used as the target cell. The data each is the average of six parallel repeats of the RTCA assay. The E/T=1/16; the pan T cells were from Healthy Donor 2.
Figure 63:
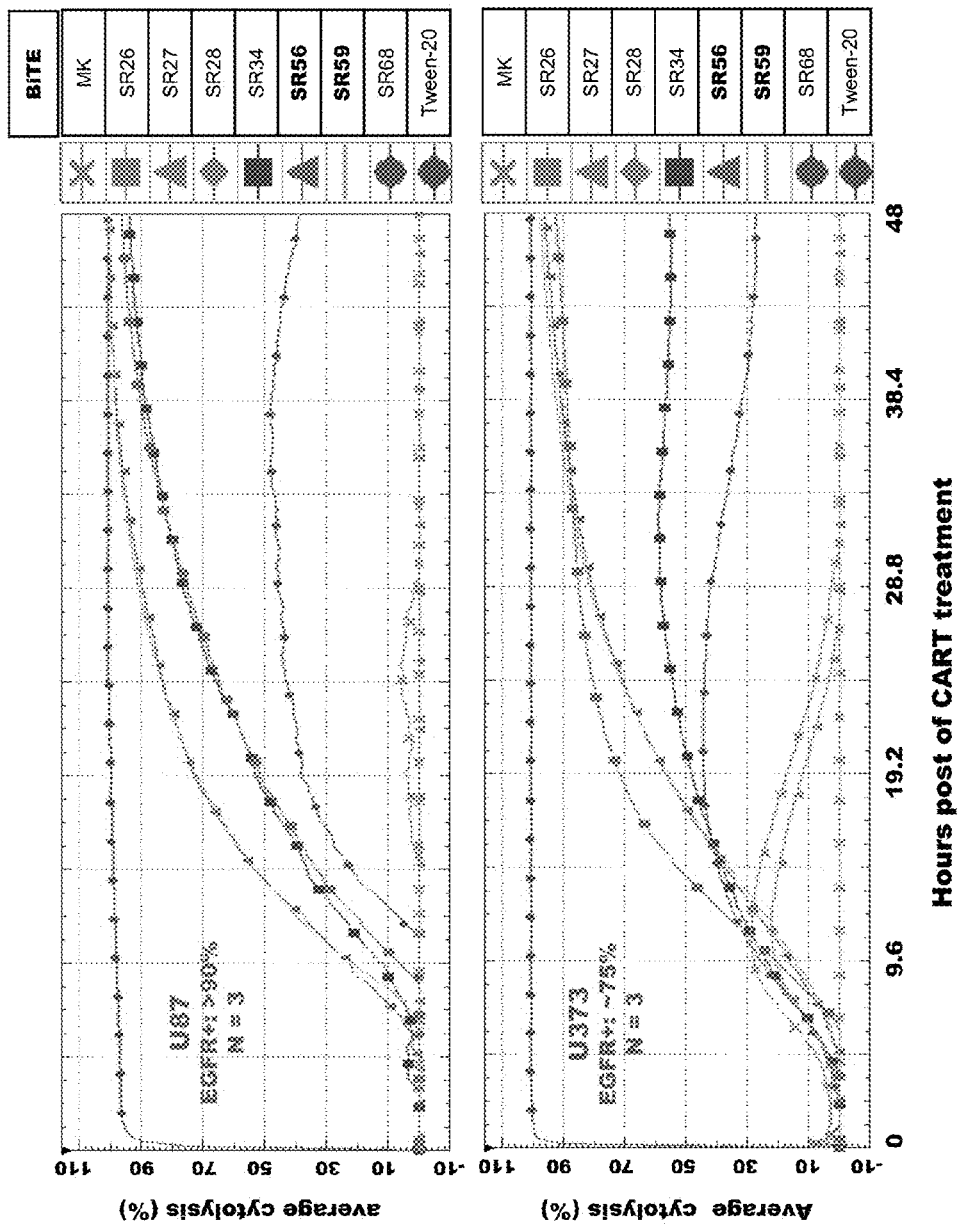
FIG. 63 shows results of an RTCA-based killing assay. After two rounds of BiTE functional screening, two lead anti-EGFR (wt & vIII) Vhh nanobody clones (SR56 and SR59) were have identified from 44 in-house developed candidates. The data each is the average of three parallel second-round repeats of the RTCA assay. The E/T=1/2; the pan T cells were from Healthy Donor 2; SR26, a two-arm anti-EGFR BiTE, was used as the positive control; SR27, anti-CD19 BiTE, was used as the negative control; The IL13Rα2 are positive in both U87 (45%) and U373 (42%).
Figure 64:
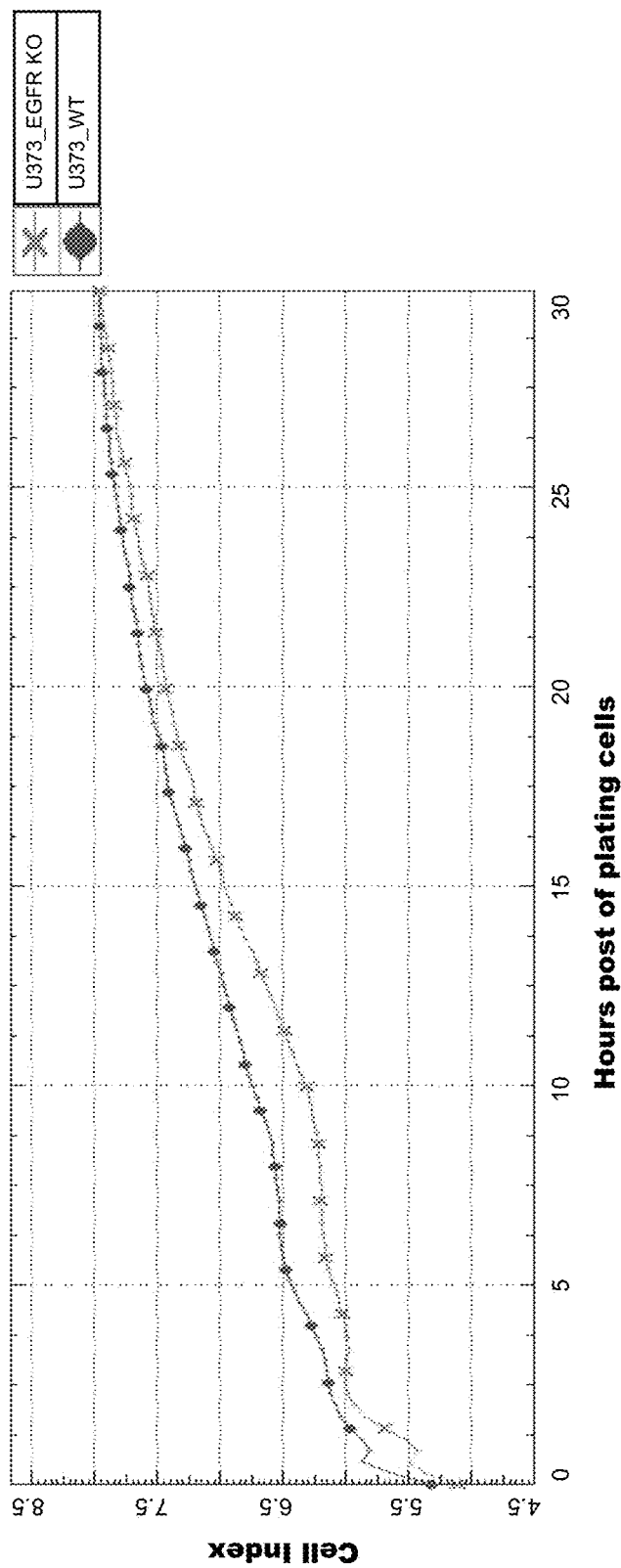
FIG. 64 shows results of an RTCA-based cellular growth index assay. The cellular growth index of the wild-type GBM cell line U373 (U373 WT) is comparable to that of the EGFR knockout U373 (U373_EGFR KO).
Figure 65:
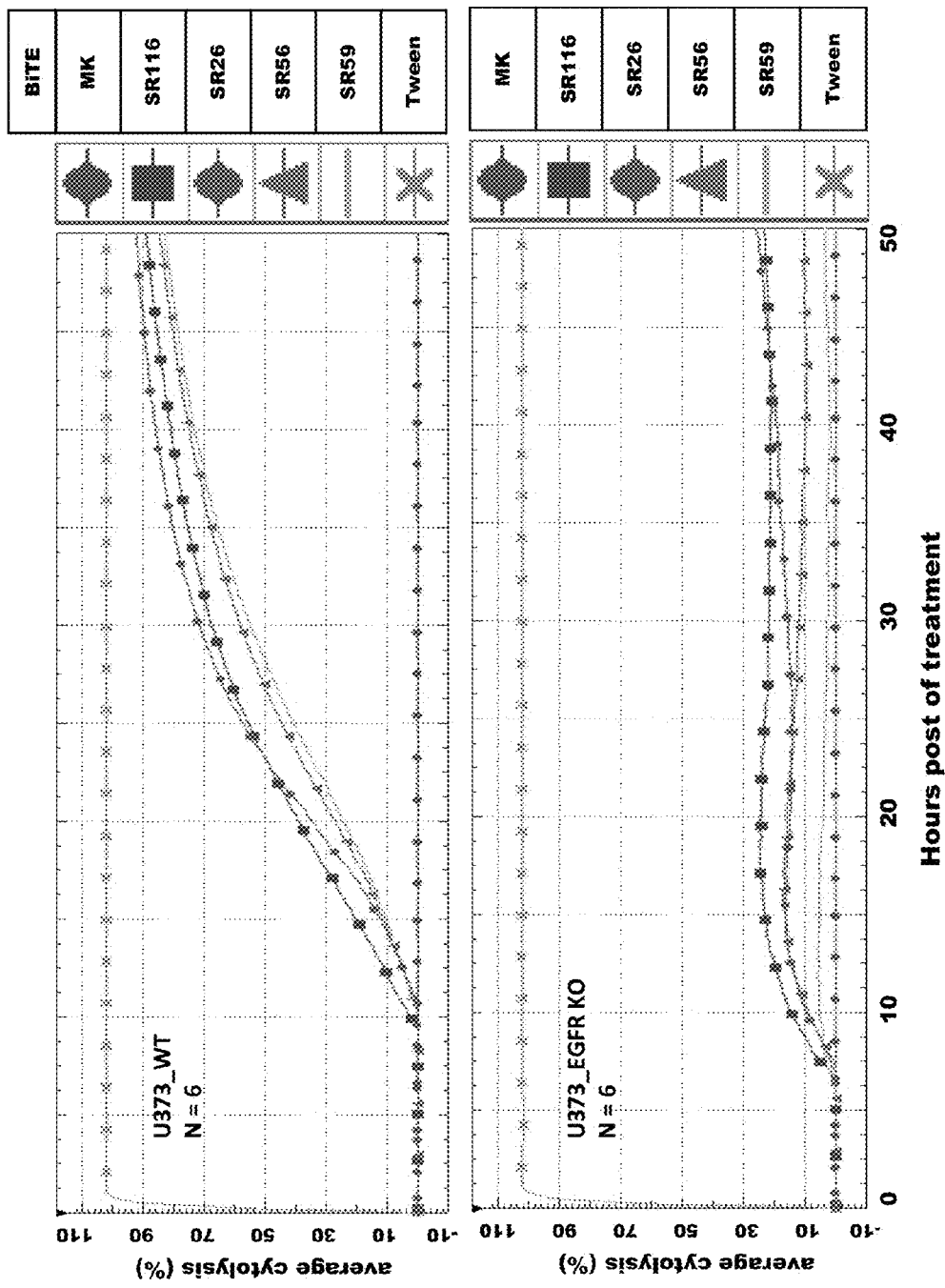
FIG. 65 shows results of an RTCA-based killing assay. To validate the specificity of the two lead anti-EGFR (wt & vIII) Vhh nanobody clones, SR56 and SR59, the RTCA based BiTE-mediated killing studies were performed. The data each is the average of six parallel repeats. The E/T=1/1; the pan T cells were from Healthy Donor 2; SR26, a two-arm anti-EGFR BiTE, was used as the positive control; SR27, anti-CD19 BiTE, was used as the negative control; SR116 is a two-EGFR_BiTE; BiTE concentration: 1 ng/ml, which was produced in 293T cells.
Figure 69:
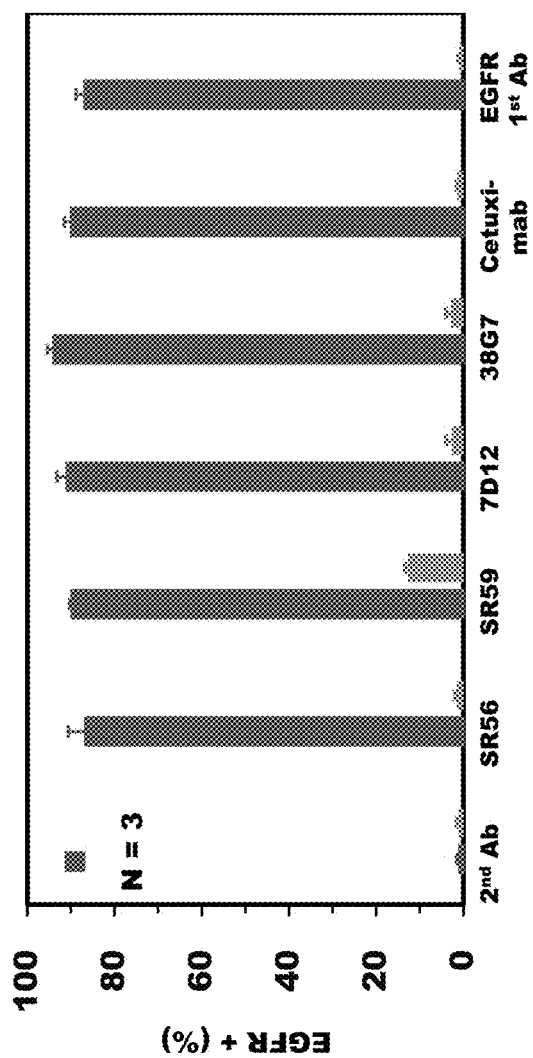
FIG. 69 summarizes results of studies, shown in FIGS. 66A-68E, of the anti-EGFR Vhh nanobody lead clones (SR56, SR59-80, 7D12 and 38G7) with the following abbreviations: WT: wild-type GBM cancer cell line U373; KO: EGFR knockout U373 cell line.
Figure 71:
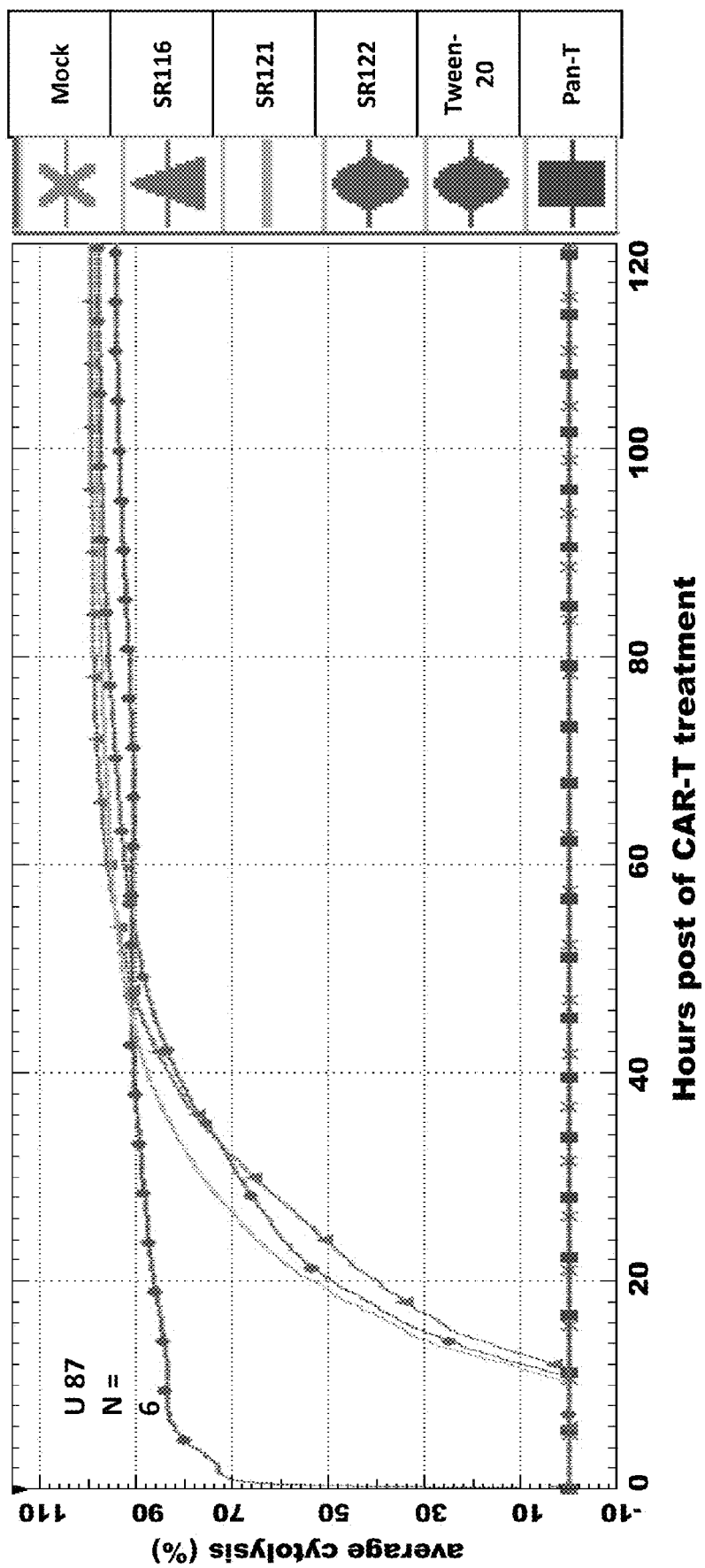
FIG. 71 shows results of RTCA-based killing assay. To identify lead EGFR Vhh two-arm BiTE clone from the top EGFR_BiTE candidates, the RTCA based killing study was performed. The data each is the average of six parallel repeats. The target cells were GBM cancer cell lines U87 (EGFR+: >92%); the E/T=1/8; the pan T cells were from Healthy Donor 2.

After discovering that the two-arm EGFR BiTE armed Dual Tandem L13Rα2-HER2 CAR-T therapy had an unprecedented killing activity to different cancer cells (e.g., GBM, breast cancer and lung cancer cells), the broader application of this BiTE and CAR composition platform was investigated. To develop a new generation (second generation) BiTE and CAR composition CAR-T therapy for GBM, lead clones of nanobody based HER2 CAR (FIGS. 46 and 49-62) and EGFR BiTE (FIGS. 47 and 63-71) were identified using the concept of BiTE and CAR composition strategy (FIG. 47), by screening top nanobodies clone pools generated in house. After identifying these BiTE and CAR lead clones, the top BiTE and CAR composition clones (SR157-SR164) were developed using the strategy in FIG. 48. The related killing activity scales are listed in Table 9.

Figure 72:
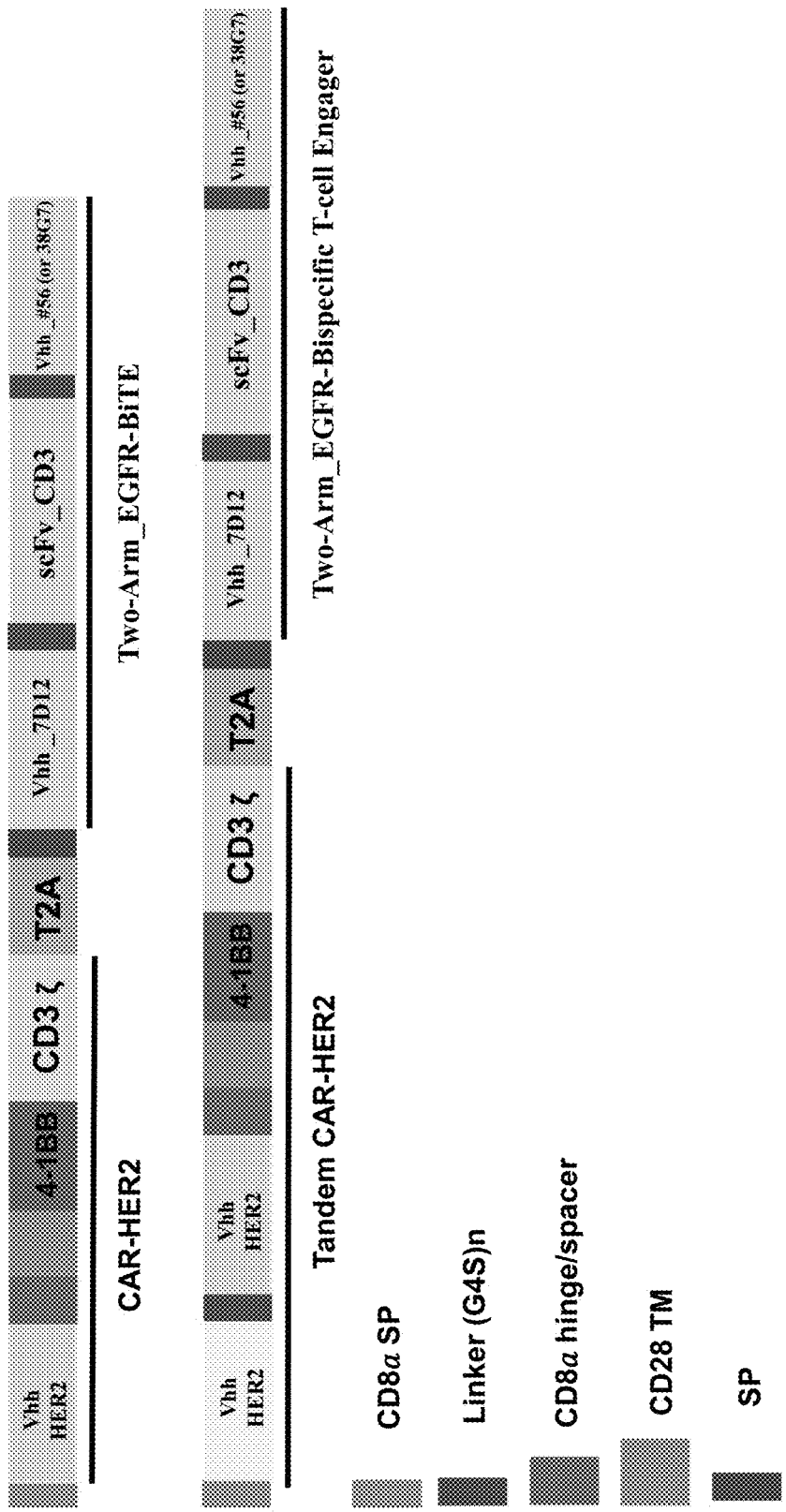
FIG. 72 is a graphic representation of a non-limiting example of two-Arm EGFR BiTE armed HER2 Vhh CAR-Ts.

Example 10. BiTE-Armed CAR-T Therapy for HER2-Positive Breast Cancer Brain Metastases To further validate the general application of the BiTE and CAR composition platform, EGFR_BiTE armed dual tandem HER2 CAR-T therapy was developed for HER2⁺ breast cancer brain metastases. The lead clones of nanobody based EGFR_BiTE and HER2 CAR were the same ones identified in the development of the second generation of BiTE-armed CAR-T therapy for GBM (FIGS. 46, 49-62, 47 and 63-71). Using the strategy in FIG. 72, the top BiTE armed CAR composition clones (SR165-SR170) were developed. The related killing activity scales are listed in Table 9.

Example 11. BiTE-Armed CAR-T Therapy for Lung Cancer Brain Metastases

Figure 73:
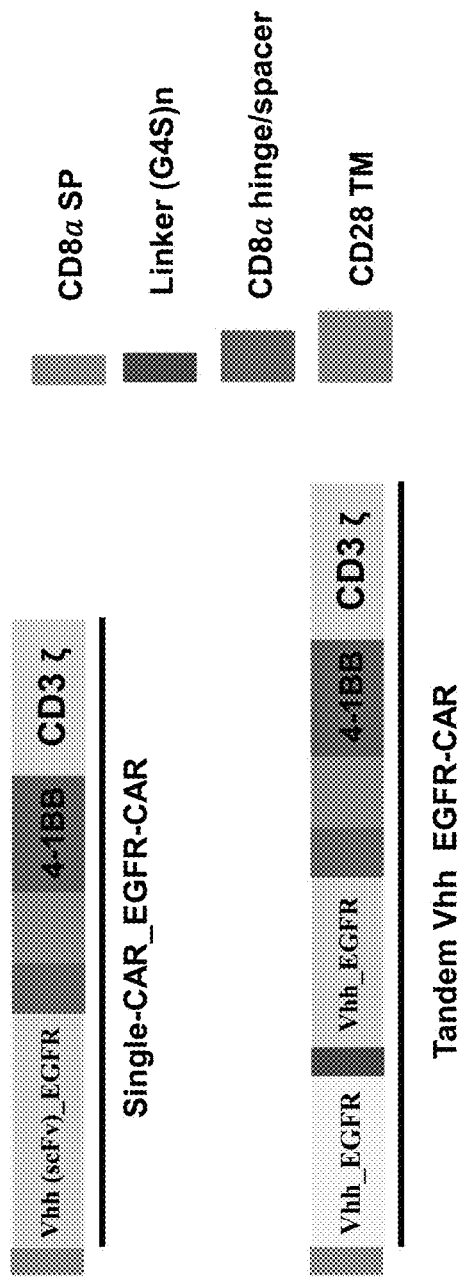
FIG. 73 is a graphic representation of a non-limiting example of EGFR CARs.
Figure 74:
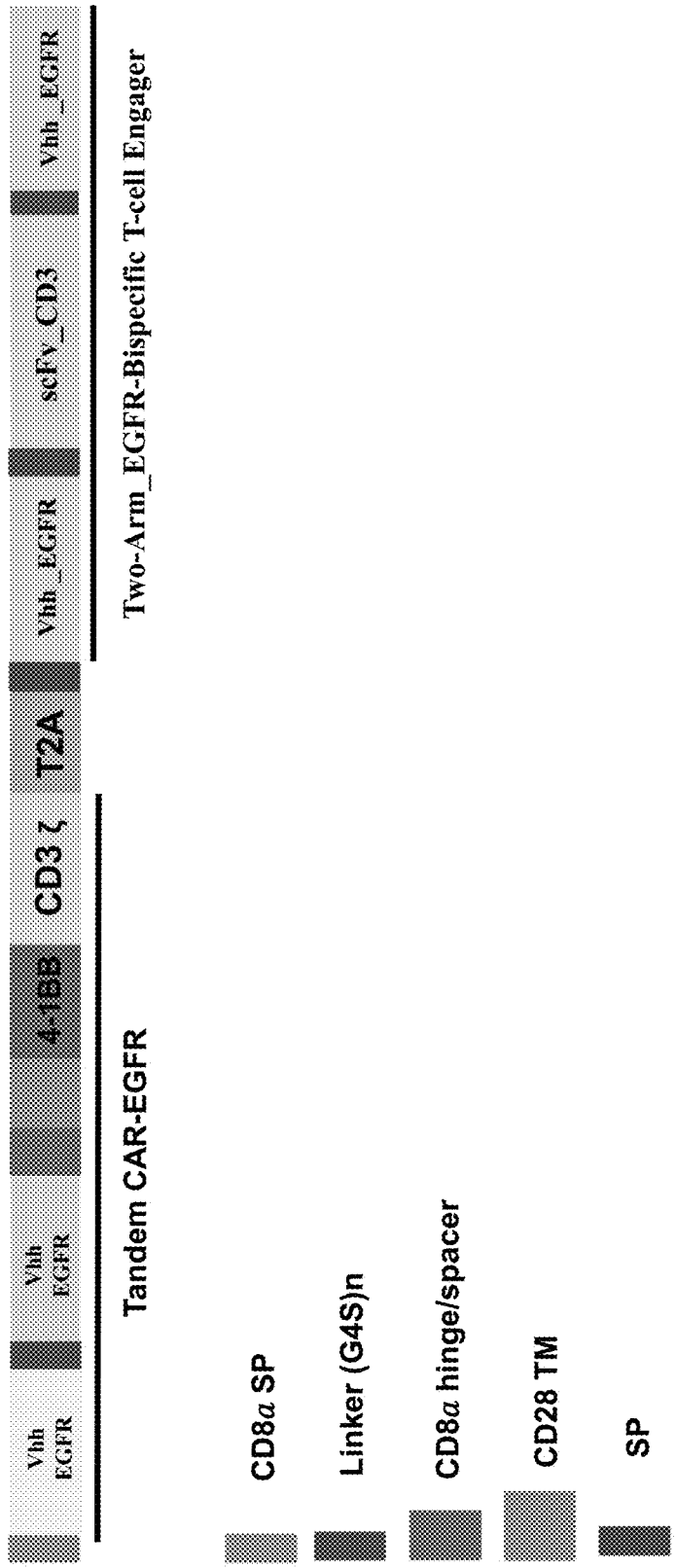
FIG. 74 is a graphic representation of a non-limiting example of two-Arm_EGFR_BiTE armed EGFR Vhh CAR-Ts.
Figure 75:
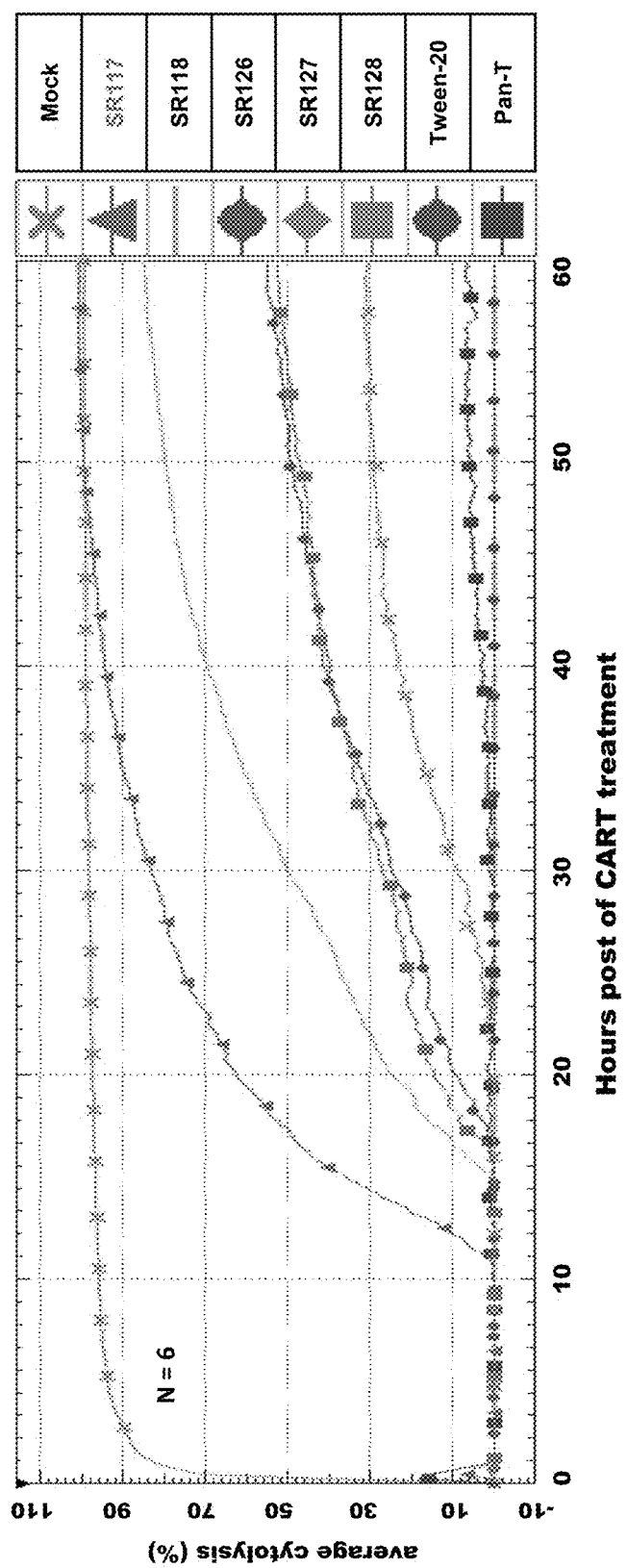
FIG. 75 shows results of an RTCA-based killing assay. To identify lead EGFR Vhh CAR-T clone from the top EGFR Vhh CAR-T candidates, the RTCA based killing study was performed. The data each is the average of six parallel repeats. The target cell was GBM cancer cell line U87; the E/T=1/4; the pan T cells were from Healthy Donor 2; SR126, cetuximab_scFv-EGFR CAR-T, was used here as a control.
Figure 76:
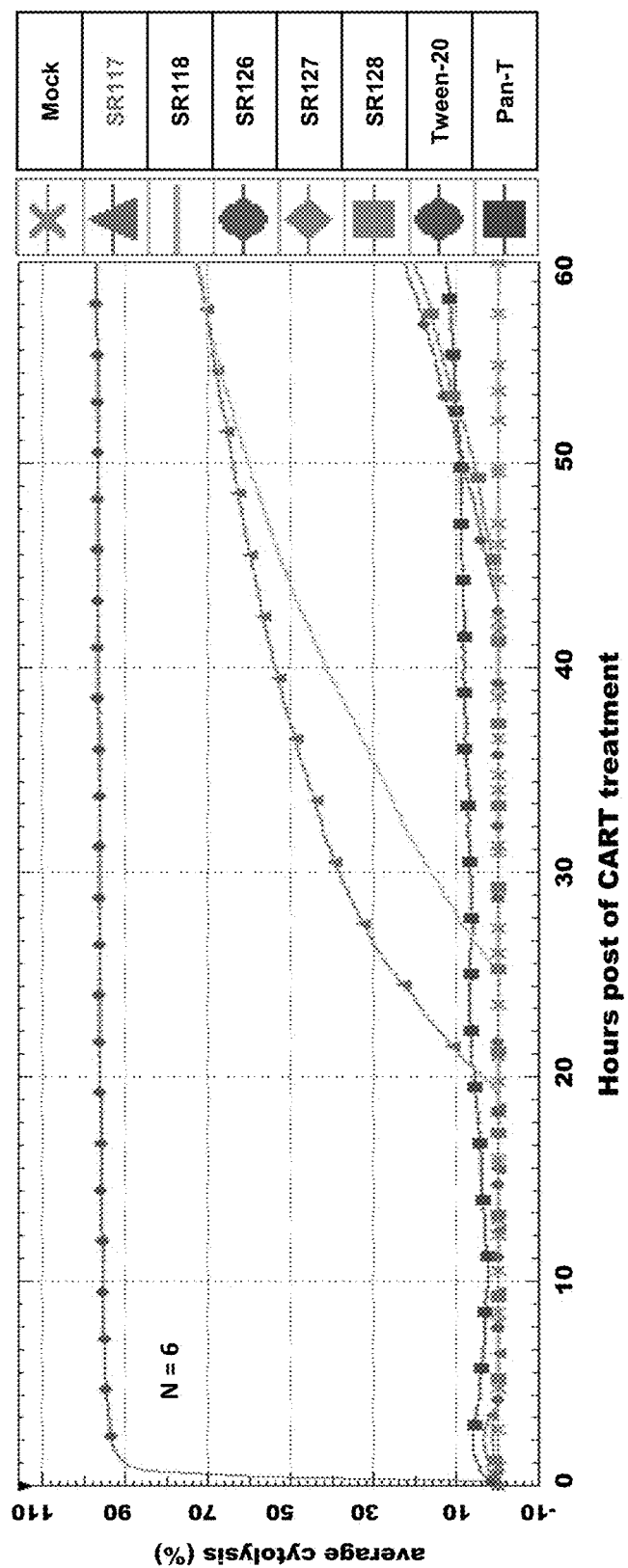
FIG. 76 shows results of an RTCA-based killing assay. To identify lead EGFR Vhh CAR-T clone from the top EGFR Vhh CAR-T candidates, the RTCA based killing study was performed. The data each is the average of six parallel repeats. The target cell was breast cancer cell line BT474; the E/T=1/4; the pan T cells were from Healthy Donor 2; SR126, cetuximab_scFv-EGFR CAR-T, was used as a control.
Figure 77:
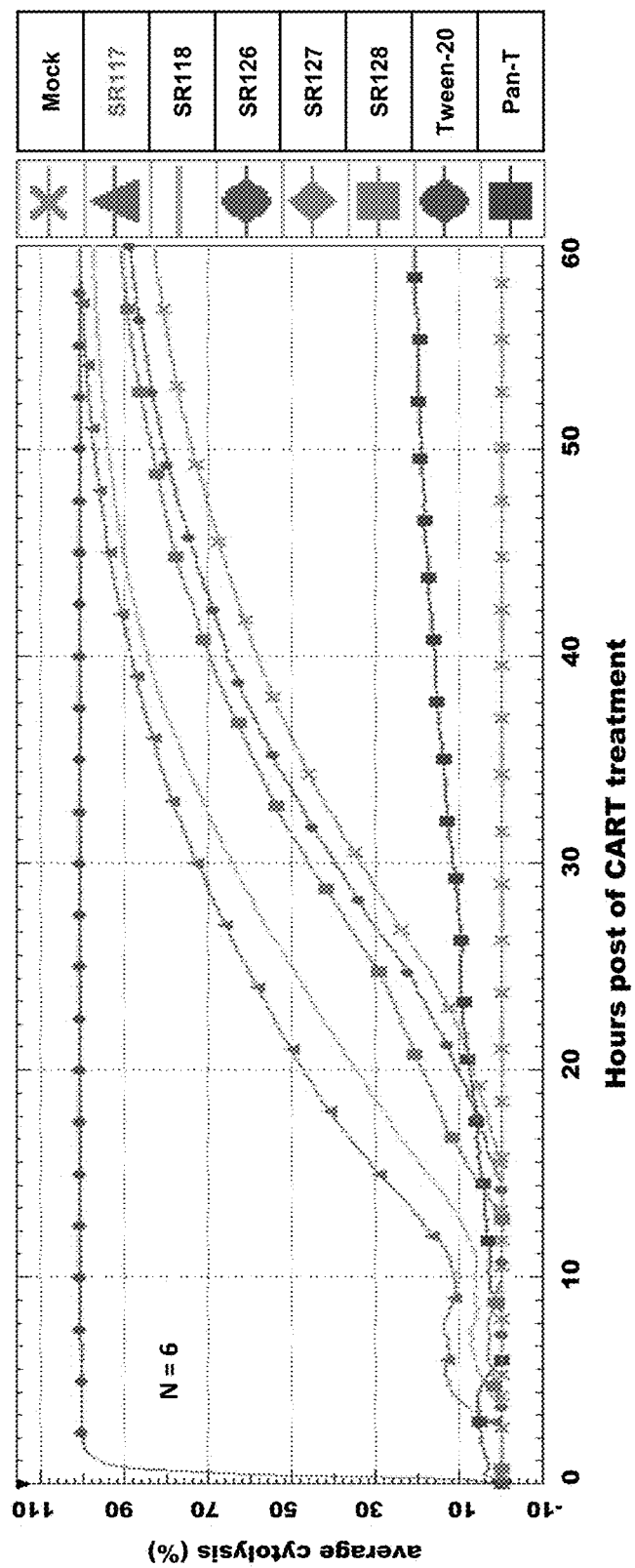
FIG. 77 shows results of an RTCA-based killing assay. To identify lead EGFR Vhh CAR-T clone from the top EGFR Vhh CAR-T candidates, the RTCA based killing study was performed. The data each is the average of six parallel repeats. The target cell was NSCLC cell line H1944; the E/T=1/8; the pan T cells were from Healthy Donor 2; SR126, cetuximab_scFv-EGFR CAR-T, was used as a control.
Figure 78:
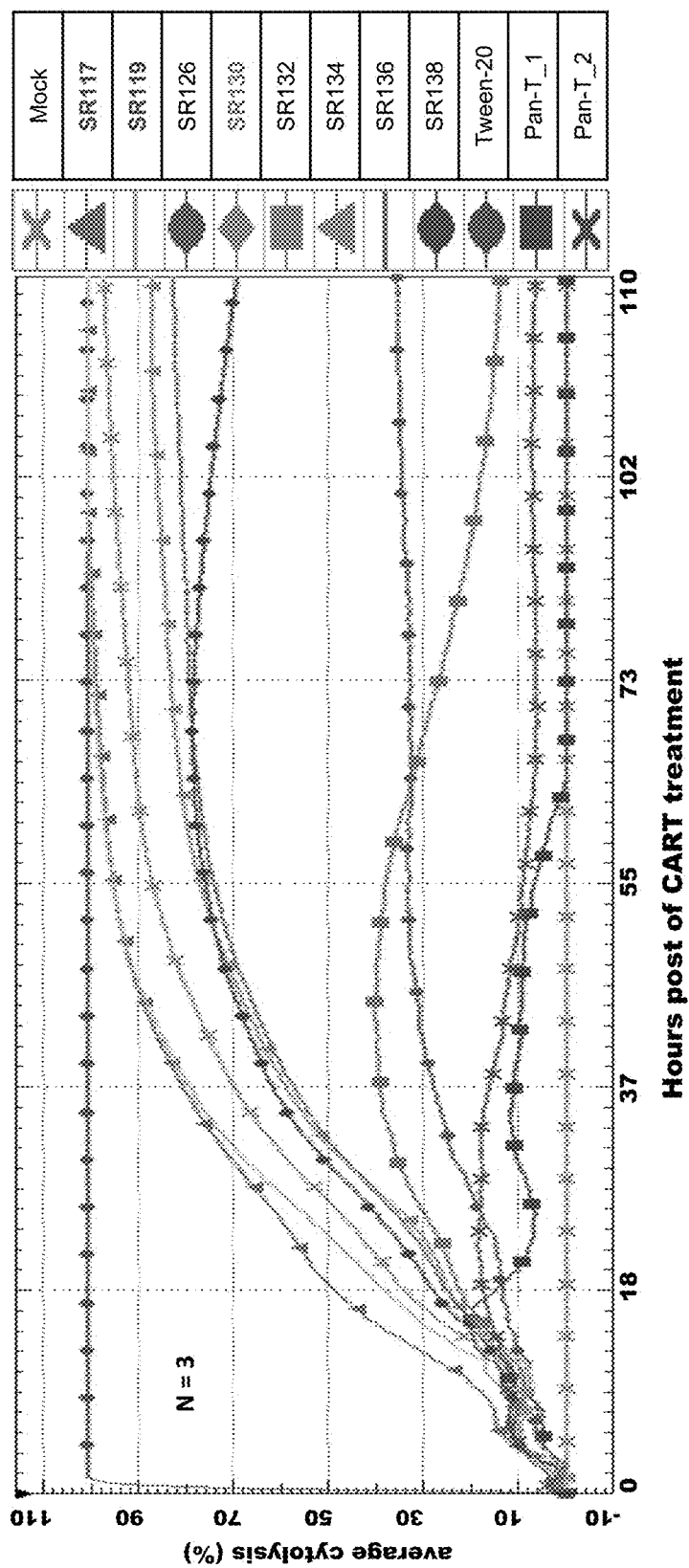
FIG. 78 shows results of an RTCA-based killing assay. To identify lead EGFR Vhh tandem CAR-T clone from the top EGFR Vhh CAR-T candidates, the RTCA based killing study was performed. The data each is the average of three parallel repeats. The target cell was NSCLC cell line H1944; the E/T=1/8; the pan T cells were from Healthy Donor 2; SR126, cetuximab_scFv-EGFR CAR-T, was used as a control.
Figure 79:
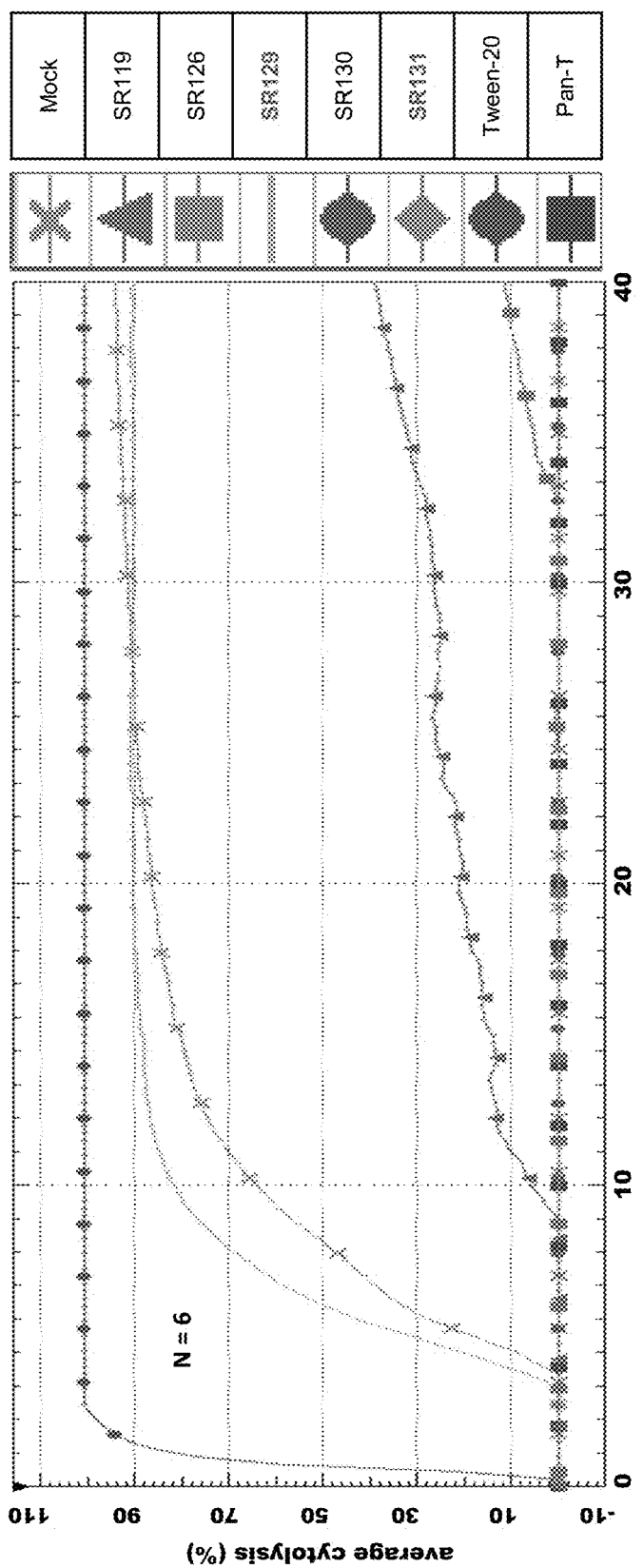
FIG. 79 shows results of an RTCA-based killing assay. To identify lead two-arm EGFR_BiTE armed EGFR Vhh tandem CAR-T clone from the top EGFR_BiTE armed EGFR Vhh CAR-T candidates, the RTCA based killing study was performed. The data each is the average of six parallel repeats. The target cell was brain metastatic NSCLC cell line H1915; the E/T=1/2; the pan T cells were from Healthy Donor 2; SR126, cetuximab_scFv-EGFR CAR-T, was used as a control.
Figure 80:
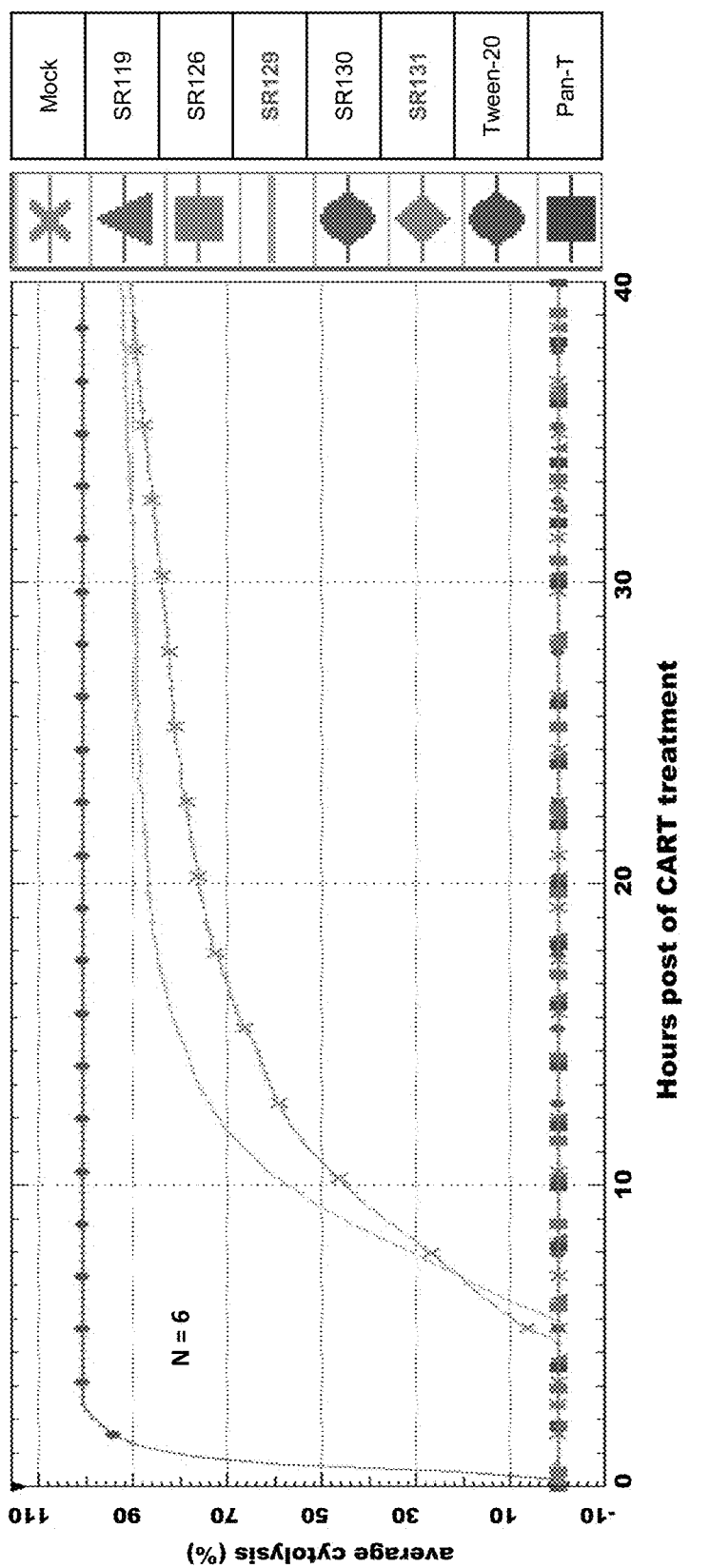
FIG. 80 shows results of an RTCA-based killing assay. To identify lead two-arm EGFR_BiTE armed EGFR Vhh tandem CAR-T clone from the top EGFR_BiTE armed EGFR Vhh CAR-T candidates, the RTCA based killing study was performed. The data each is the average of six parallel repeats. The target cell was brain metastatic NSCLC cell line H1915; the E/T=1/4; the pan T cells were from Healthy Donor 2; SR126, cetuximab_scFv-EGFR CAR-T, was used as a control.
Figure 81:
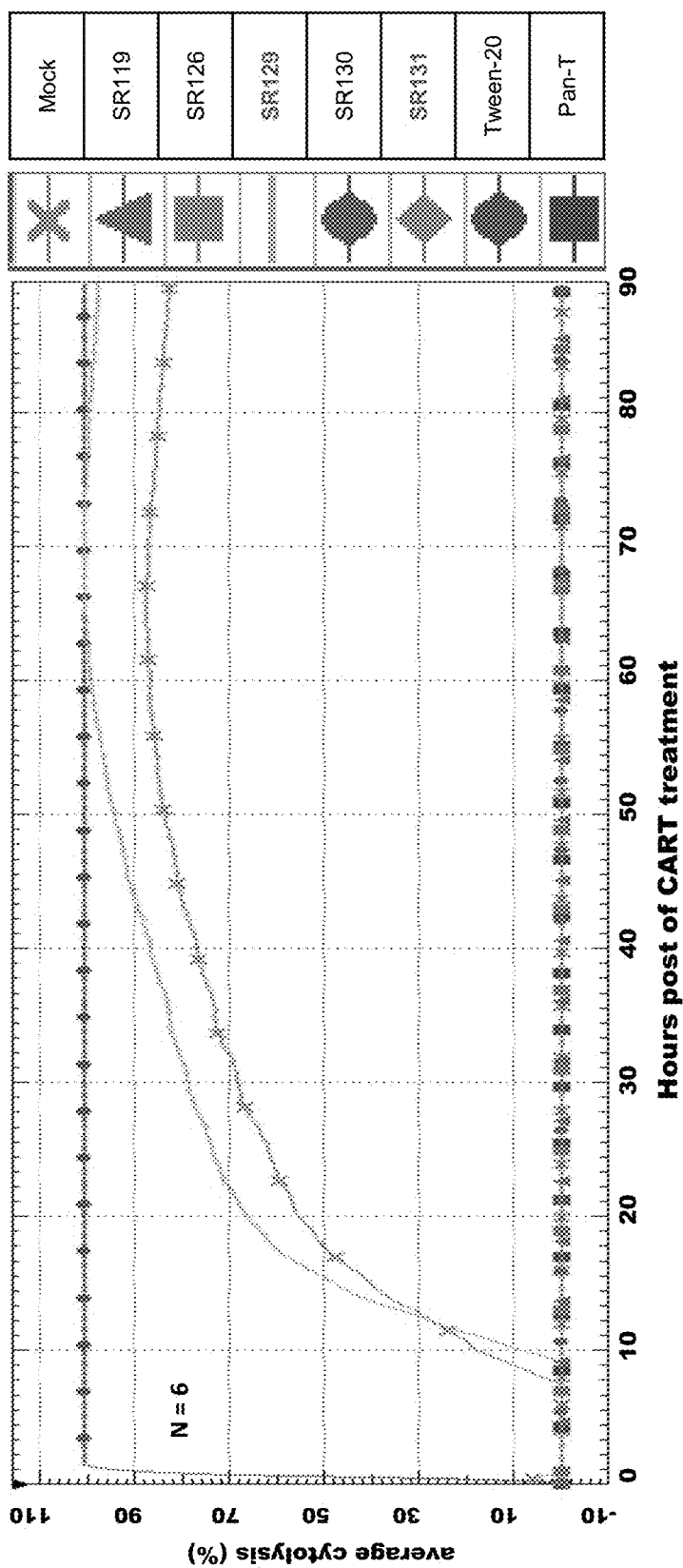
FIG. 81 shows results of a aRTCA-based killing assay. To identify lead two-arm EGFR_BiTE armed EGFR Vhh tandem CAR-T clone from the top EGFR_BiTE armed EGFR Vhh CAR-T candidates, the RTCA based killing study was performed. The data each is the average of six parallel repeats. The target cell was brain metastatic NSCLC cell line H1915; the E/T=1/8; the pan T cells were from Healthy Donor 2; SR126, cetuximab_scFv-EGFR CAR-T, was used as a control.
Figure 82:
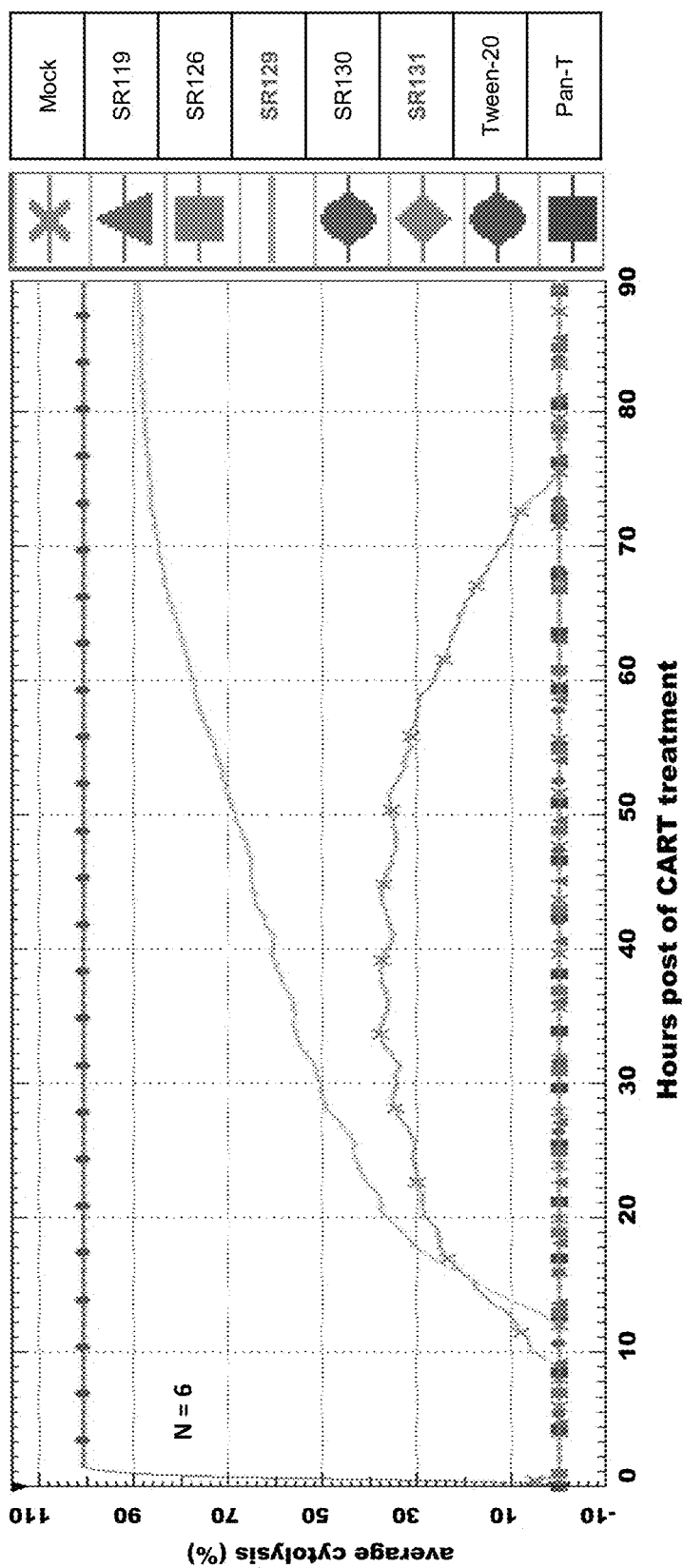
FIG. 82 shows results of an RTCA-based killing assay. To identify lead two-arm EGFR_BiTE armed EGFR Vhh tandem CAR-T clone from the top EGFR_BiTE armed EGFR Vhh CAR-T candidates, the RTCA based killing study was performed. The data each is the average of six parallel repeats. The target cell was brain metastatic NSCLC cell line H1915; the E/T=1/16; the pan T cells were from Healthy Donor 2; SR126, cetuximab_scFv-EGFR CAR-T, was used as a control.
Figure 83:
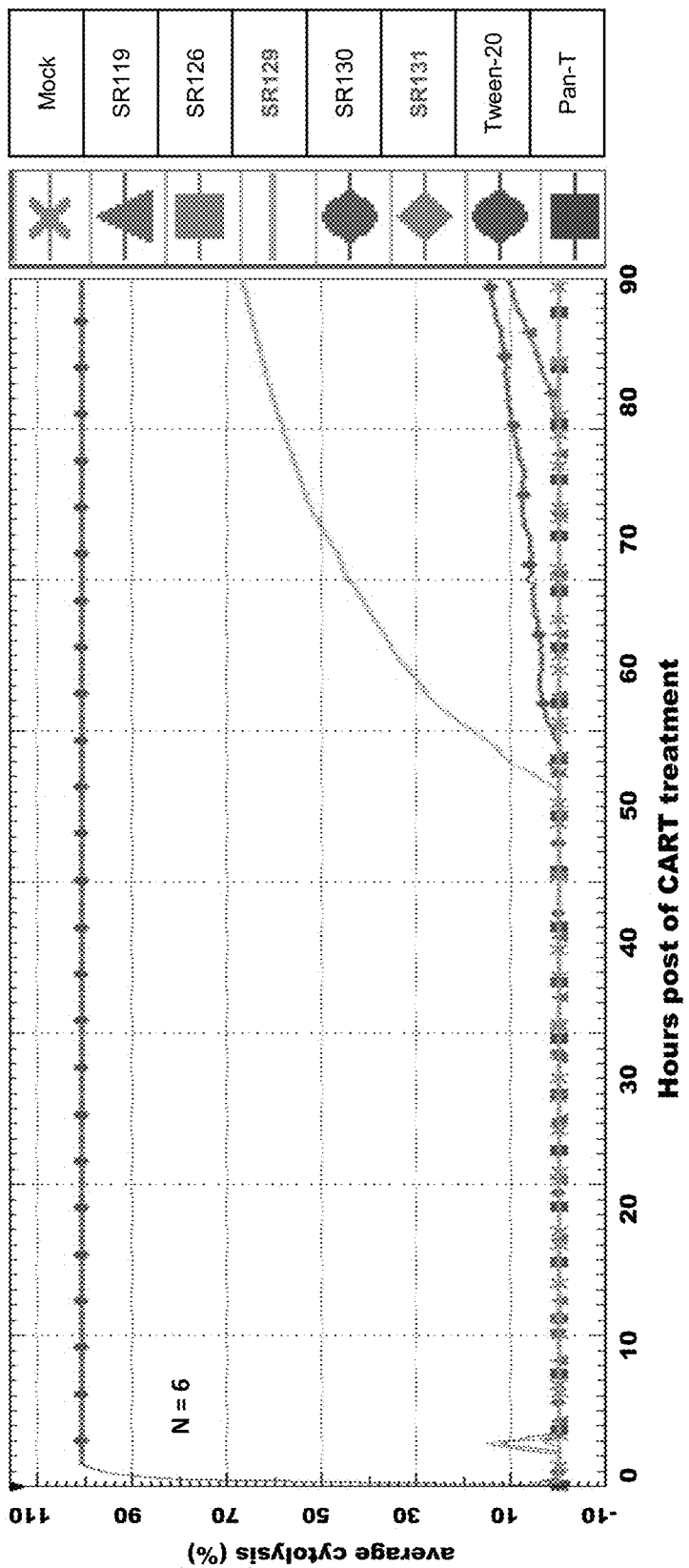
FIG. 83 shows results of an RTCA-based killing assay. To identify lead two-arm EGFR_BiTE armed EGFR Vhh tandem CAR-T clone from the top EGFR_BiTE armed EGFR Vhh CAR-T candidates, the RTCA based killing study was performed. The data each is the average of six parallel repeats. The target cell was brain metastatic NSCLC cell line H1915; the E/T=1/32; the pan T cells were from Healthy Donor 2; SR126, cetuximab_scFv-EGFR CAR-T, was used as a control.
Figure 84:
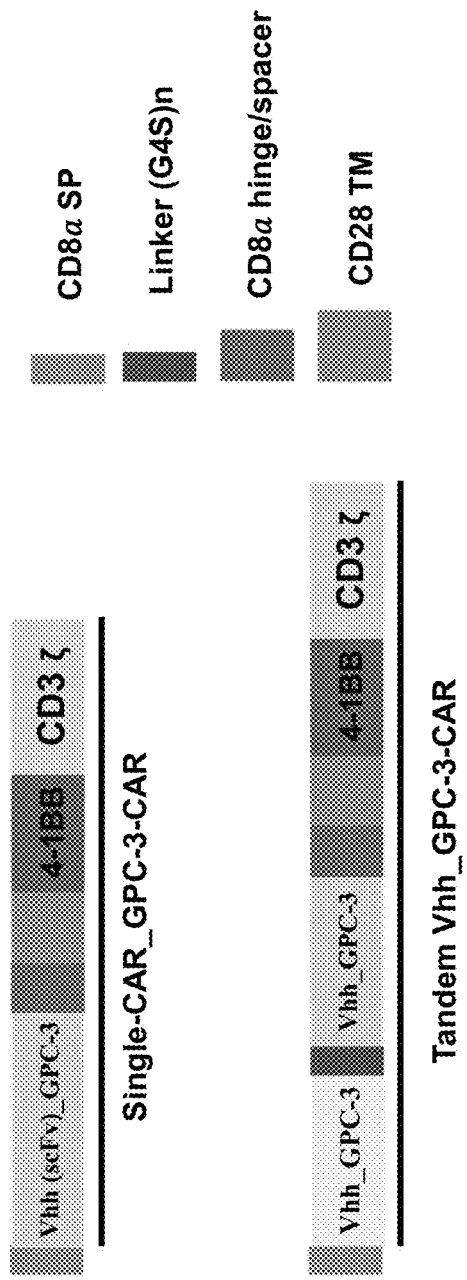
FIG. 84 is a graphic representation of a non-limiting example of GPC-3 CARs.

To generalize the application of the BiTE and CAR composition platform, EGFR_BiTE armed dual tandem EGFR CAR-T therapy was developed for lung cancer brain metastases. The lead clones of nanobody based EGFR_BiTE were the same ones identified in the development of the second generation of BiTE-armed CAR-T therapy for GBM (FIGS. 47 and 63-71). The lead clones of nanobody based EGFR_CAR were identified using the strategy in FIG. 73 and the experimental approaches in FIGS. 75-78. Using the strategy in FIG. 74 and detail experimental screening assays (FIGS. 79-83), the lead clone of two-arm EGFR BiTE armed EGFR Vhh tandem CAR-T, SR129, was identified. This lead BiTE and CAR composition CAR-T cell has an un-precedented killing activity to lung cancer brain metastatic cancer cells. The related killing activity scales are listed in Table 9.

Example 12. GPC-3 Vhh BiTE-Armed CAR-T Therapy for HCC

Figure 85:
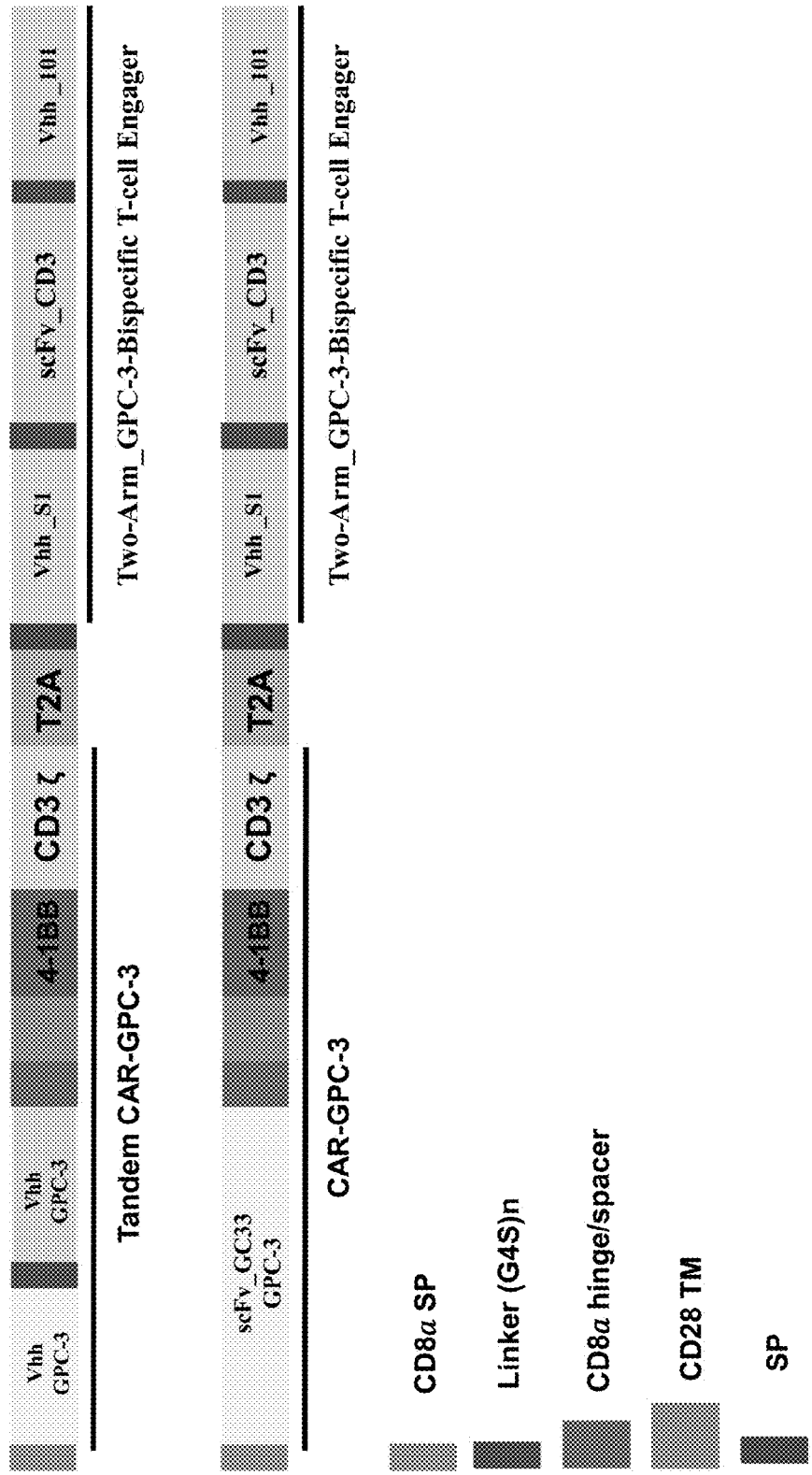
FIG. 85 is a graphic representation of a non-limiting example of two-Arm_GPC-3_BiTE armed GPC-3 CAR-Ts.
Figure 86:
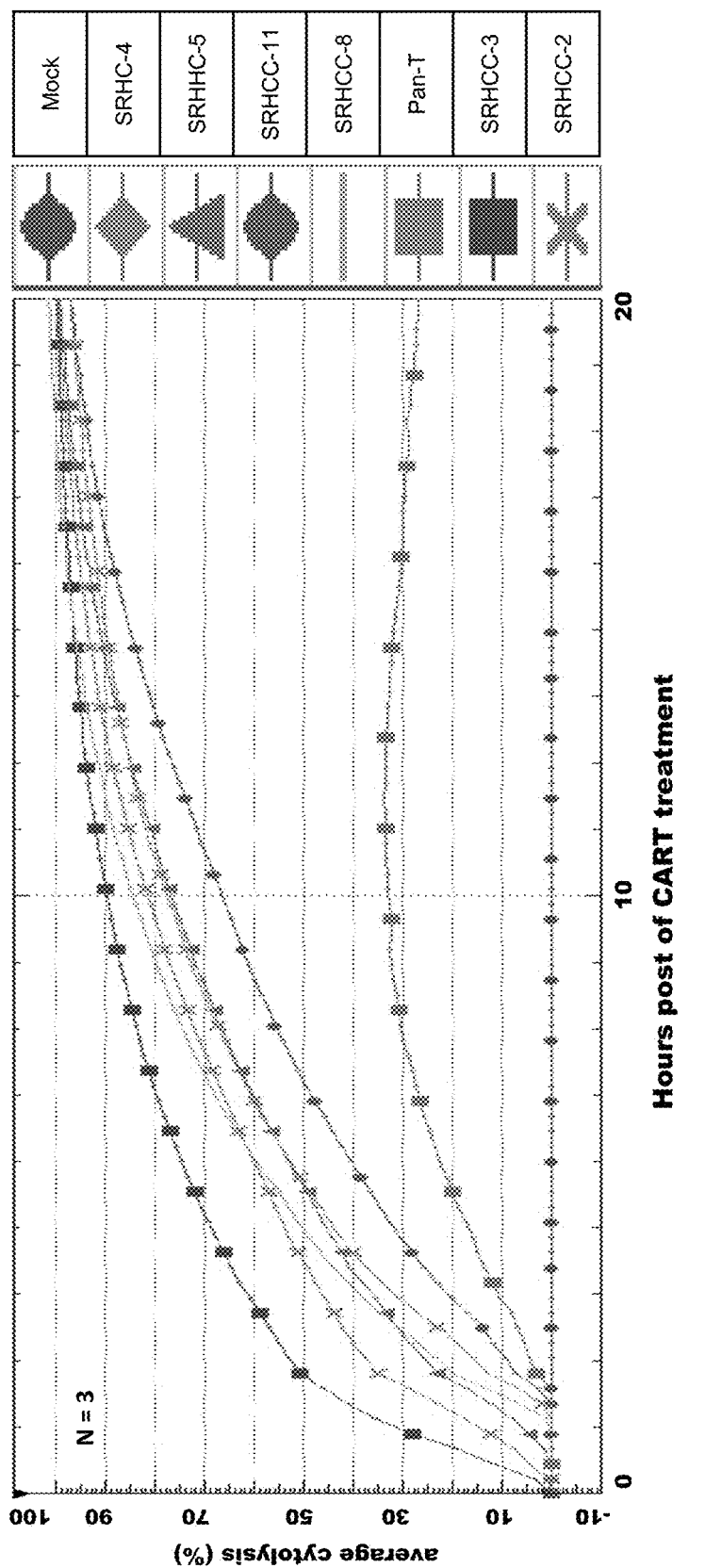
FIG. 86 shows results of an RTCA-based killing assay. To identify top GPC-3 Vhh CAR-T clone from in-house developed GPC-3 nanobody candidates, the RTCA based killing study was performed. The data each is the average of three parallel repeats. The target cell was HCC cancer cell line Huh-7; the E/T=1/1; the pan T cells were from Healthy Donor 3; SRHC-4, GPC-3 GC-33_scFv CAR-T, and SRHCC-2, GPC-3 Vhh CAR-T were used as controls.
Figure 87:
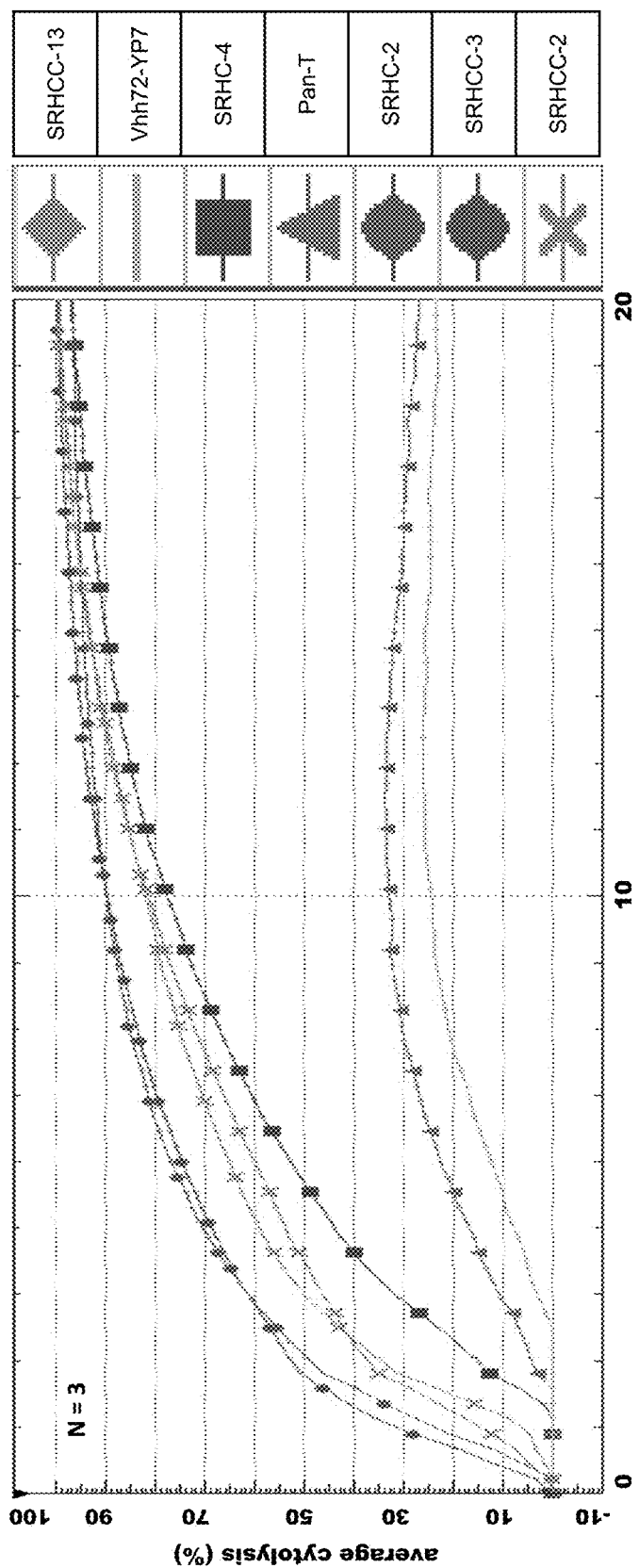
FIG. 87 shows results of an RTCA-based killing assay. To identify top GPC-3 Vhh CAR-T clone from in-house developed GPC-3 nanobody candidates, the RTCA based killing study was performed. The data each is the average of three parallel repeats. The target cell was HCC cancer cell line Huh-7; the E/T=1/1; the pan T cells were from Healthy Donor 3; SRHC-4, GPC-3 GC-33_scFv CAR-T, Vhh72-YP7 CAR-T and SRHCC-2, GPC-3 Vhh CAR-T were used as controls.
Figure 88:
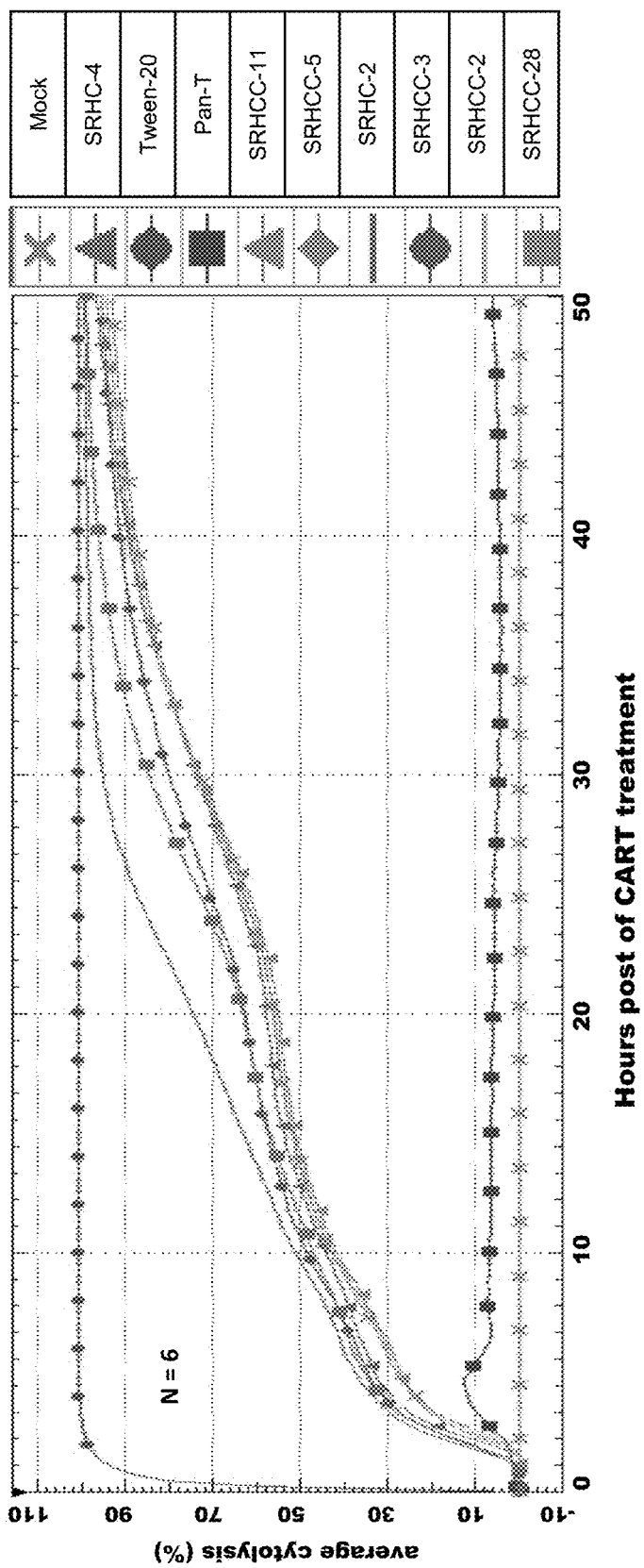
FIG. 88 shows results of an RTCA-based killing assay. To identify top GPC-3 Vhh CAR-T clone from in-house developed GPC-3 nanobody candidates, the RTCA based killing study was performed. The data each is the average of six parallel repeats. The target cell was HCC cancer cell line Hep3B; the E/T=1/2; the pan T cells were from Healthy Donor 3; SRHC-4, GPC-3 GC-33_scFv CAR-T, and SRHCC-2, GPC-3 Vhh CAR-T were used as controls.
Figure 89:
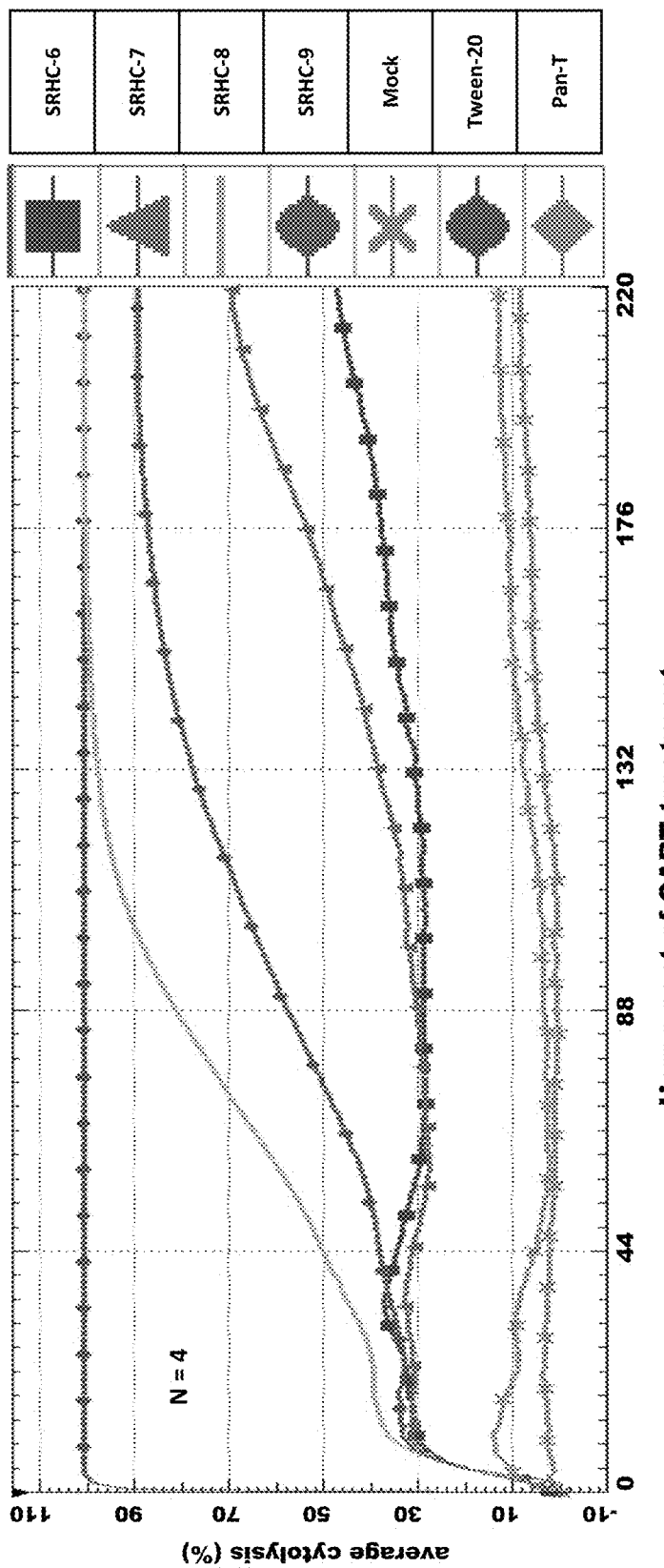
FIG. 89 shows results of RTCA-based killing assay. To identify lead two-arm GPC-3_BiTE armed GPC-3 Vhh tandem CAR-T clone from the top GPC-3_BiTE armed GPC-3 Vhh CAR-T candidates, the RTCA based killing study was performed. The data each is the average of four parallel repeats. The target cell was HCC cancer cell line HepG2; the E/T=1/4; the pan T cells were from Healthy Donor 5.
Figure 90:
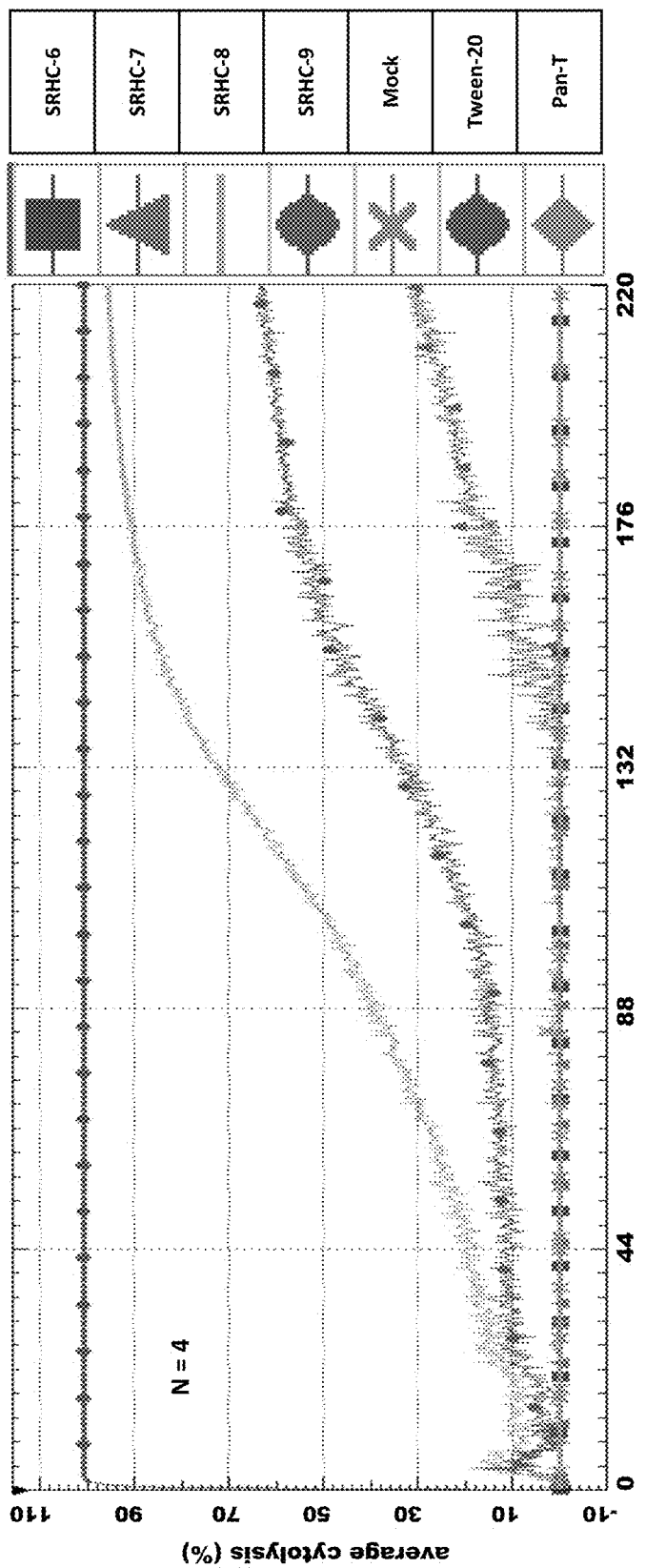
FIG. 90 shows results of an RTCA-based killing assay. To identify lead two-arm GPC-3_BiTE armed GPC-3 Vhh tandem CAR-T clone from the top GPC-3_BiTE armed GPC-3 Vhh CAR-T candidates, the RTCA based killing study was performed. The data each is the average of four parallel repeats. The target cell was HCC cancer cell line Hep3B; the E/T=1/4; the pan T cells were from Healthy Donor 5.
Figure 91:
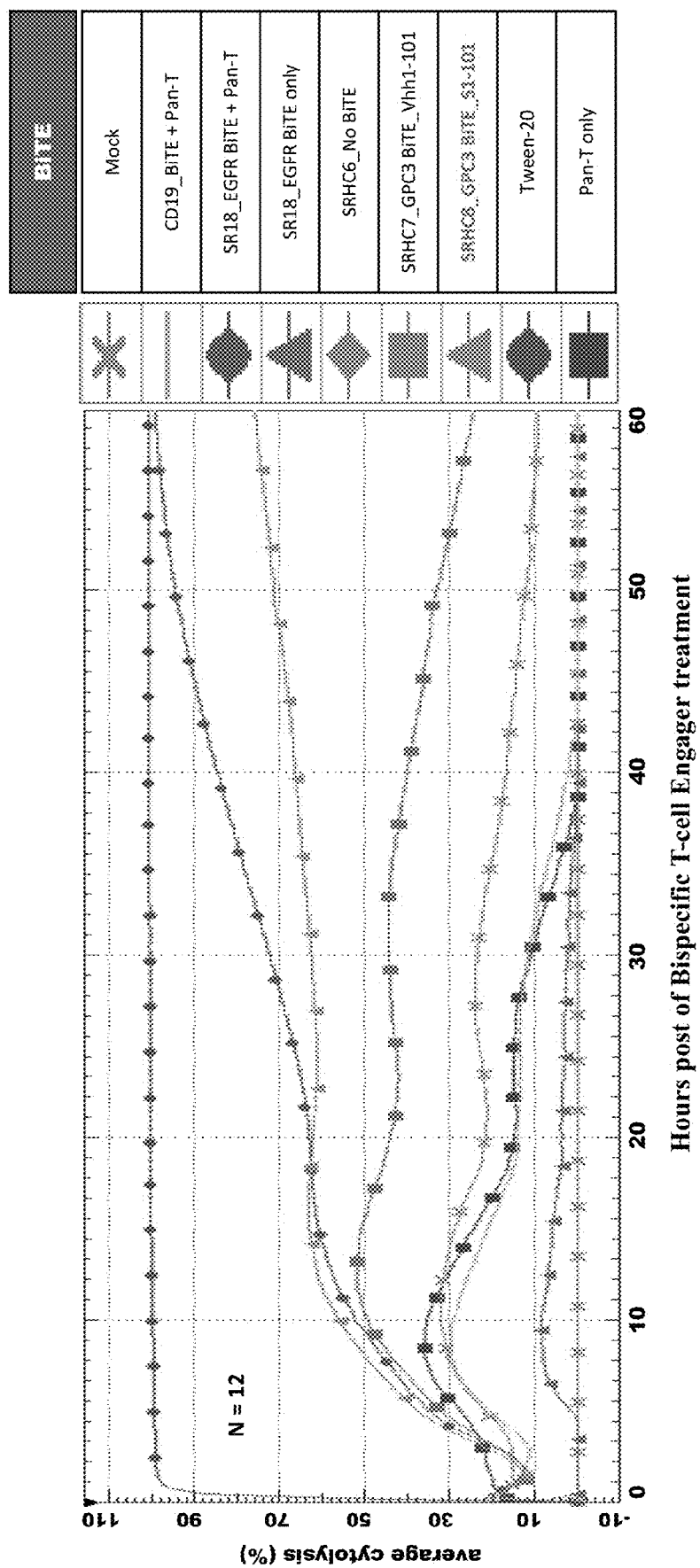
FIG. 91 shows results of an RTCA-based killing assay. To further validate lead two-arm GPC-3_BiTE (SRHC-8_GPC3 BiTE_S1-101) function, the RTCA based killing study was performed. The data each is the average of twelve parallel repeats. The target cell was HCC cancer cell line Hep3B; the E/T=1/1; BiTE concentration: 4 ng/ml; the pan T cells were from Healthy Donor 5.
Figure 92:
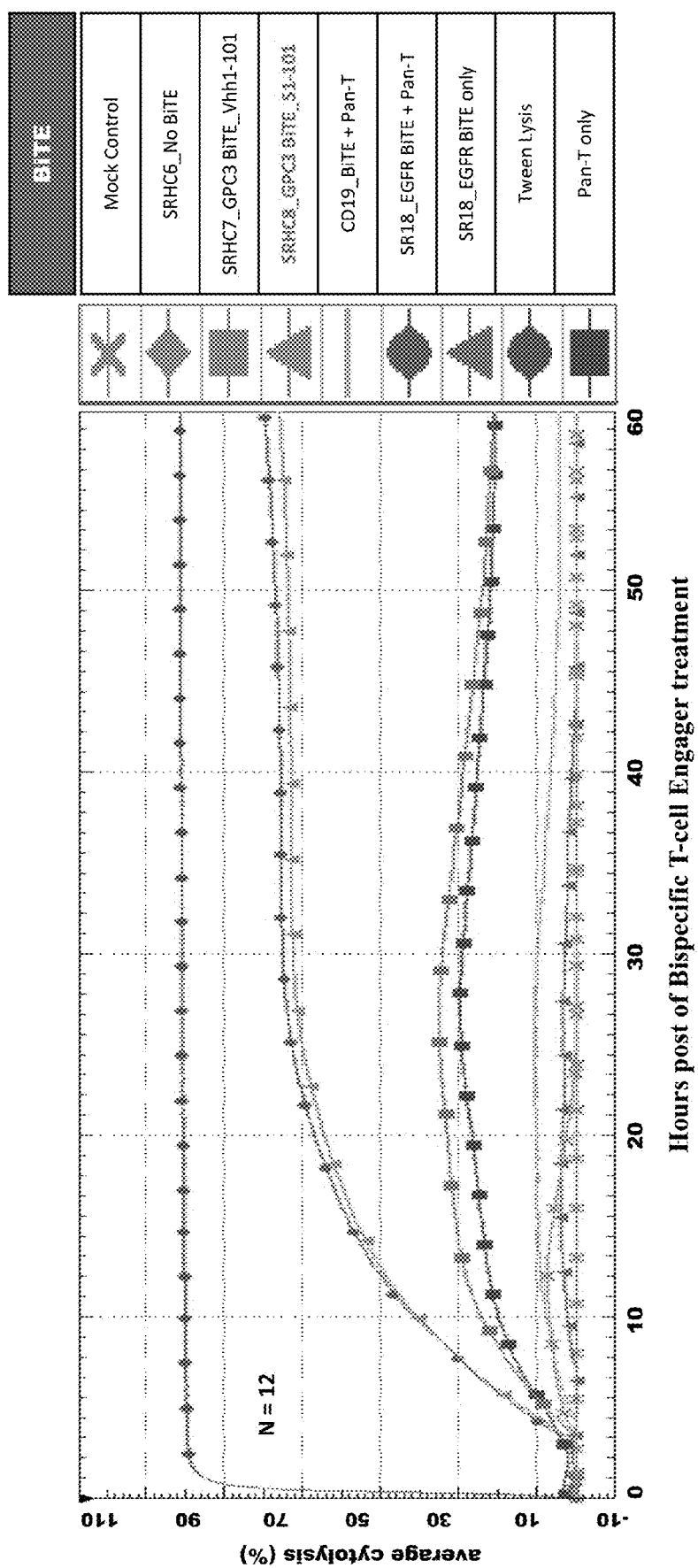
FIG. 92 shows results of an RTCA-based killing assay. To further validate lead two-arm GPC-3_BiTE (SRHC-8_GPC3 BiTE_S1-101) function, the RTCA based killing study was performed. The data each is the average of twelve parallel repeats. The target cell was HCC cancer cell line HepG2; the E/T=1/1; BiTE concentration: 4 ng/ml; the pan T cells were from Healthy Donor 5.
Figure 93:
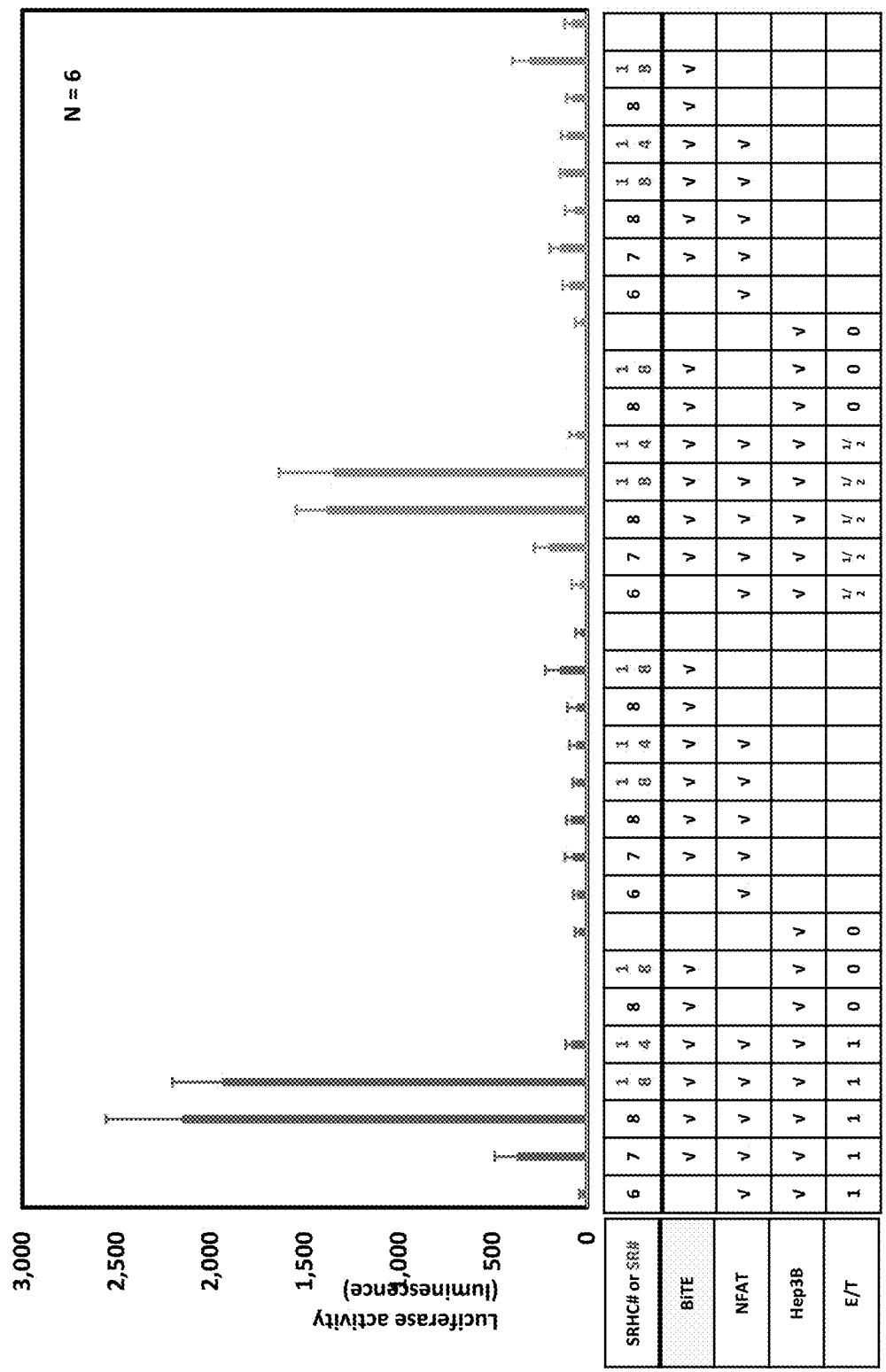
FIG. 93 shows results of an NFAT cell-based luciferase assay. To validate the capacity of the lead two-arm GPC-3_BiTE (SRHC-8_GPC3 BiTE_S1-101) to induce T cell activation, the NFAT cell-based luciferase assay was performed. The data each is the average of six parallel repeats. The target cell was HCC cancer cell line Hep3B; the E/T=1/1; BiTE concentration: 4 ng/ml.
Figure 94:
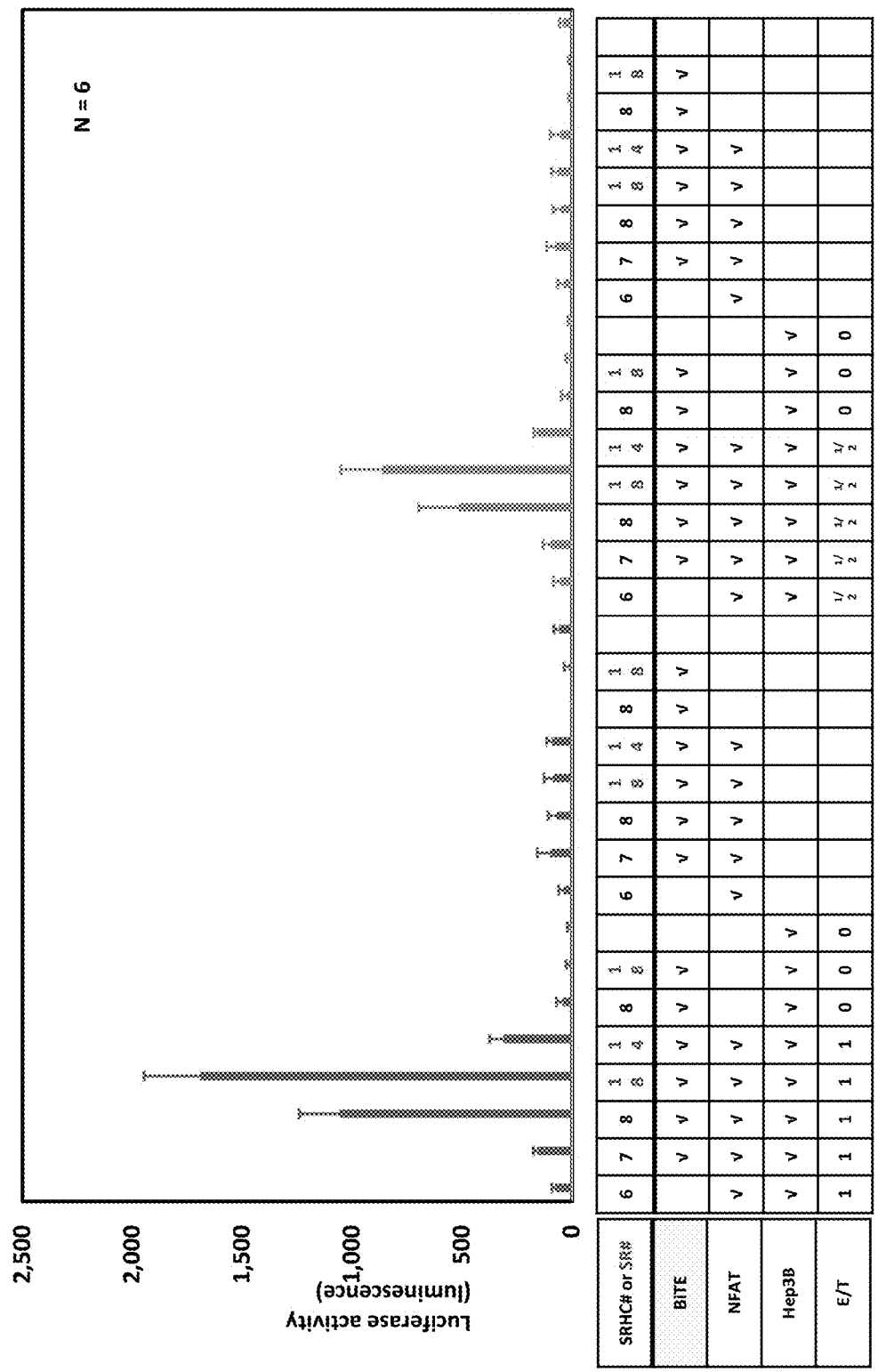
FIG. 94 shows results of an NFAT cell-based luciferase assay. To validate the capacity of the lead two-arm GPC-3_BiTE (SRHC-8_GPC3 BiTE_S1-101) to induce T cell activation, the NFAT cell-based luciferase assay was performed. The data each is the average of six parallel repeats. The target cell was HCC cancer cell line HepG2; the E/T=1/1; BiTE concentration: 4 ng/ml.
Figure 95:
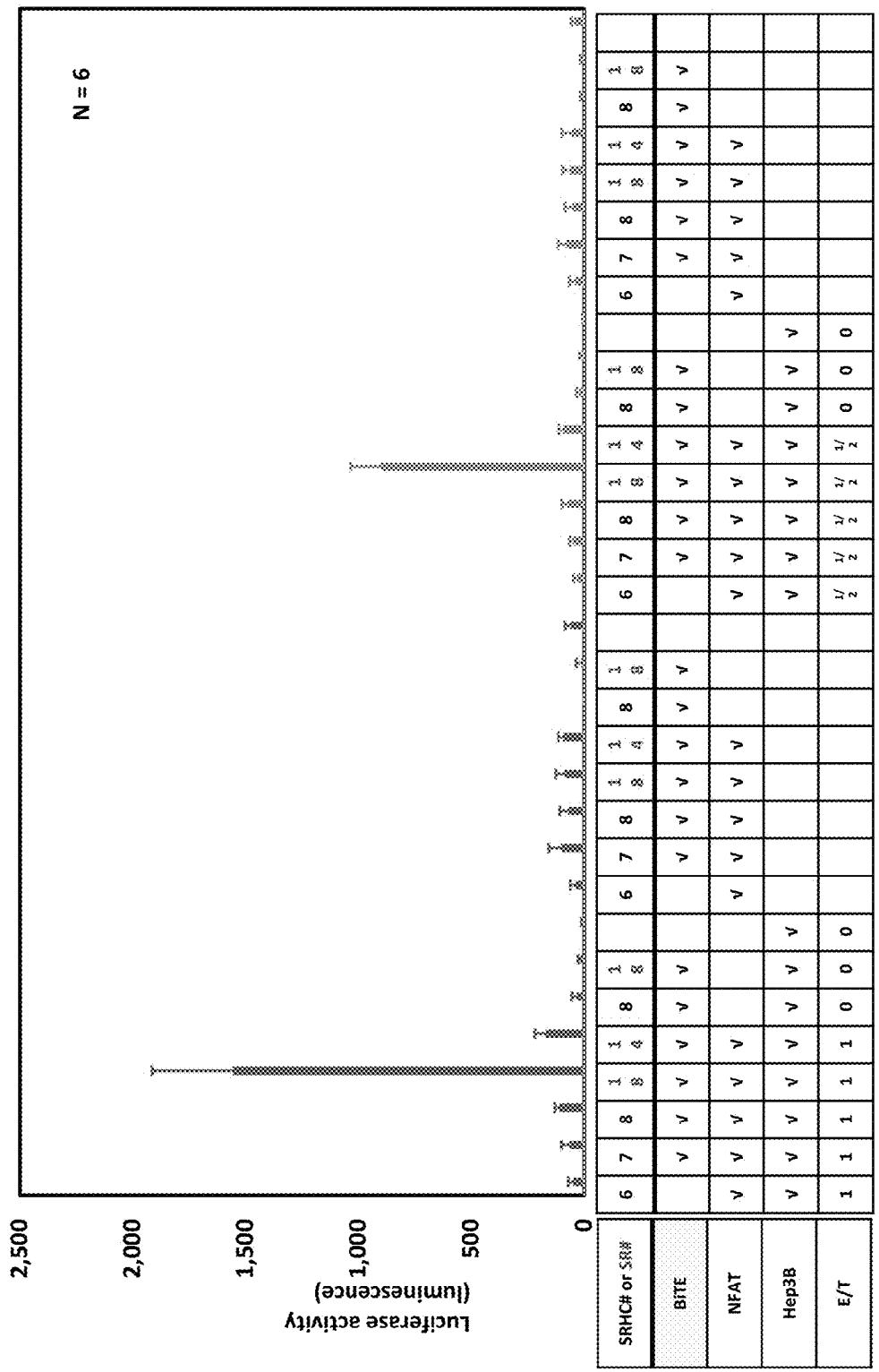
FIG. 95 shows results of an NFAT cell-based luciferase assay. To validate the capacity of the lead two-arm GPC-3_BiTE (SRHC-8_GPC3 BiTE_S1-101) to induce T cell activation, the NFAT cell-based luciferase assay was performed. The data each is the average of six parallel repeats. The target cell was HCC cancer cell line SK-Hep1, which is GPC-3 negative but EGFR positive; the E/T=1/1; BiTE concentration: 4 ng/ml.
Figure 96:
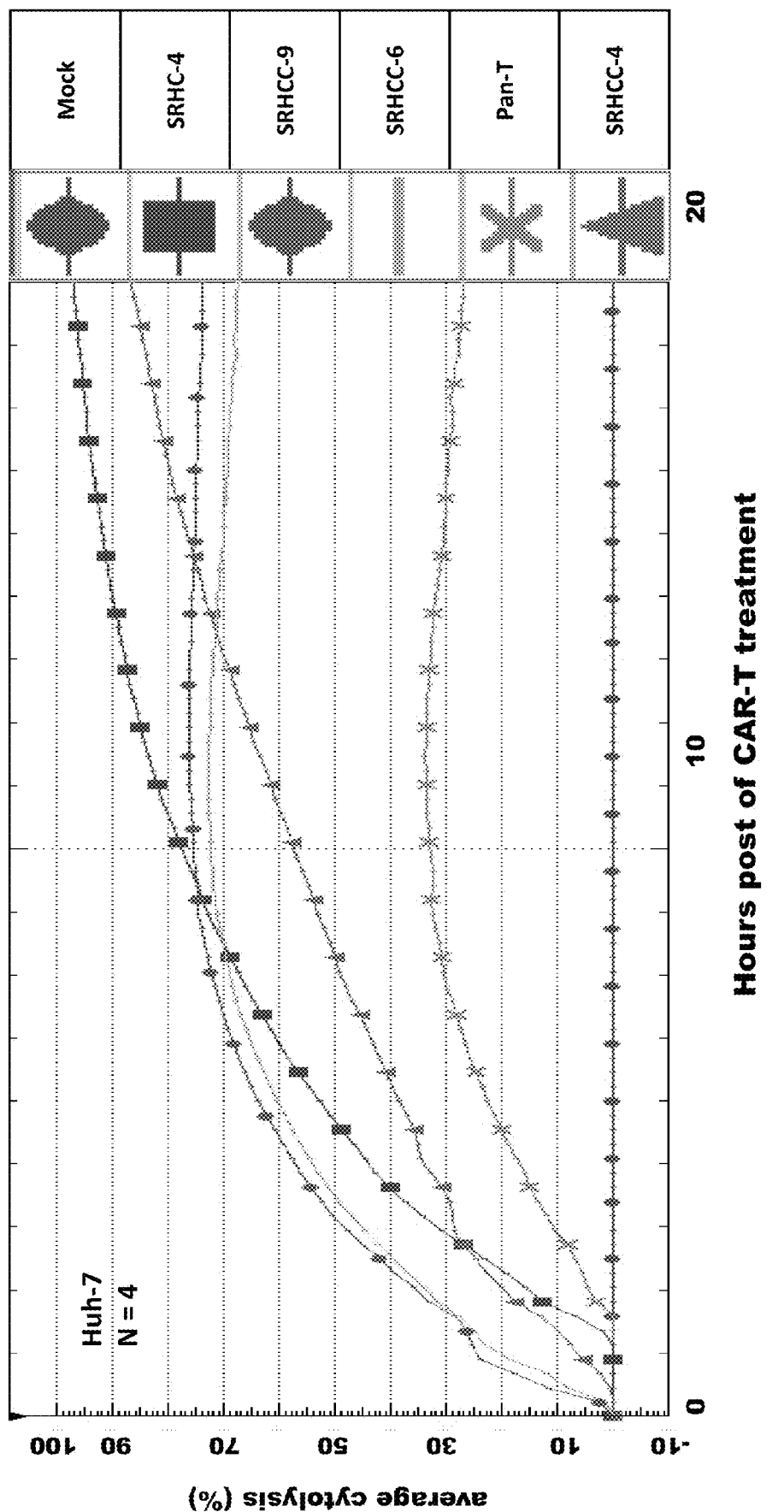
FIG. 96 shows results of an RTCA-based killing assay. To identify top GPC-3 Vhh CAR-T clone from GPC-3 nanobody candidates developed in-house, the RTCA based killing study was performed. The data is the average of four parallel repeats. The target cell was HCC cancer cell line Huh-7; the E/T=1/1; the pan T cells were from the Healthy Donor 3; SRHC-4, GPC-3 GC-33_scFv CAR-T.

To further generalize the application of the BiTE and CAR composition platform, GPC-3_BiTE armed dual tandem GPC-3 CAR-T therapy was developed for hepatocellular carcinoma. First, the lead clones of nanobody based GPC-3 CAR were identified from top anti-GPC-3 nanobody clones developed in house (FIGS. 84, 86-88 and 96). Through BiTE and CAR composition strategy (FIG. 85), the lead clone of nanobody based GPC-3 two-arm BiTE (FIGS. 91 and 92) was identified, whose capacity to induce T cell activation was confirmed using NFAT assay (FIGS. 93-95). Through the same strategy (FIG. 85), the lead clone of two-arm GPC-3 BiTE armed GPC-3 Vhh tandem CAR-T was also identified (FIGS. 89 and 90). This GPC-3 BiTE armed GPC-3 CAR-T lead clone has a much stronger killing activity to HCC cancer cells. The related killing activity scales are listed in Table 9. It demonstrates that the BiTE and CAR composition platform has a very general application in developing effective CAR-T therapy for cancer.

The teachings of all patents, published applications and references cited herein are incorporated by reference in their entirety.

While example embodiments have been particularly shown and described, it will be understood by those skilled in the art that various changes in form and details may be made therein without departing from the scope of the embodiments encompassed by the appended claims.

TABLE 1

Non-limiting Examples of Amino Acid Sequences of Dual-CAR Constructs and Components Thereof

| SEQ ID NO: | Name | Amino Acid Sequence |
|---|---|---|
| 1 | IL13 mutein | SPGPVPPSTALRYLIEELVNITQNQKAPLCNGSMVWSINLTAGMYCAA LESLINVSGCSAIEKTQRMLSGFCPHKVSAGQFSSLHVRDTKIEVAQF VKDLLLHLKKLFREGRFN |
| 2 | HER2 scFv (4D5) | DIQMTQSPSSLSASVGDRVTITCRASQDVNTAVAWYQQKPGKAPKLLI YSASFLESGVPSRFSGSGSGTDFTLTISSLQPEDFATYYCQQHYTTPP TFGQGTKVEIKGGGGSGGGGSGGGGSEVQLVESGGGLVQPGGSLRLSC AASGFNIKDTYIHWVRQAPGKGLEWVARIYPTNGYTRYADSVKGRFTI SADDSKNTLYLQMNSLRAEDTAVYYCARWGGDGFYAMDVWGQGTLVTV SS |
| 3 | | DIQMTQSPSSLSASVGDRVTITCRASQDVNTAVAWYQQKPGKAPKLLI YSASFLESGVPSRFSGSRSGTDFTLTISSLQPEDFATYYCQQHYTTPP TEGQGTKVEIKGGGGSGGGGSGGGGSEVQLVESGGGLVQPGGSLRLSC AASGFNIKDTYIHWVRQAPGKGLEWVARIYPTNGYTRYADSVKGRFTI SADTSKNTAYLQMNSLRAEDTAVYYCSRWGGDGFYAMDVWGQGTLVTV SS |
| 4 | | DIQMTQSPSSLSASVGDRVTITCRASQDVNTAVAWYQQKPGKAPKLLI YSASFLYSGVPSRFSGSRSGTDFTLTISSLQPEDFATYYCQQHYTTPP TEGQGTKVEIKGGGGSGGGGSGGGGSEVQLVESGGGLVQPGGSLRLSC AASGFNIKDTYIHWVRQAPGKGLEWVARIYPTNGYTRYADSVKGRFTI SADTSKNTAYLQMNSLRAEDTAVYYCSRWGGDGFYAMDYWGQGTLVTV SS |
| 5 | linker | GGGGSGGGGSGGGGS |
| 6 | CD8α signal peptide | MALPVTALLLPLALLLHAARP |
| 7 | CD8α hinge/spacer | TTTPAPRPPTPAPTIASQPLSLRPEACRPAAGGAVHTRGLDFACD |
| 8 | CD28 transmembrane domain | FWVLVVVGGVLACYSLLVTVAFIIFWV |
| 9 | 4-1BB | KRGRKKLLYIFKQPFMRPVQTTQEEDGCSCRFPEEEEGGCEL |
| 10 | CD3-zeta | RVKFSRSADAPAYQQGQNQLYNELNLGRREEYDVLDKRRGRDPEMGGK PRRKNPQEGLYNELQKDKMAEAYSEIGMKGERRRGKGHDGLYQGLSTA TKDTYDALHMQALPPR |
| 11 | SR7: IL13 mutein-HER2(4D5 #2) | MALPVTALLLPLALLLHAARPSPGPVPPSTALRYLIEELVNITQNQKA PLCNGSMVWSINLTAGMYCAALESLINVSGCSAIEKTQRMLSGFCPHK VSAGQFSSLHVRDTKIEVAQFVKDLLLHLKKLFREGRFNGGGGSGGGG SGGGGSDIQMTQSPSSLSASVGDRVTITCRASQDVNTAVAWYQQKPGK APKLLIYSASFLESGVPSRFSGSGSGTDFTLTISSLQPEDFATYYCQQ HYTTPPTFGQGTKVEIKGGGGSGGGGSGGGGSEVQLVESGGGLVQPGG SLRLSCAASGFNIKDTYIHWVRQAPGKGLEWVARIYPTNGYTRYADSV KGRFTISADDSKNTLYLQMNSLRAEDTAVYYCARWGGDGFYAMDVWGQ GTLVTVSSTTTPAPRPPTPAPTIASQPLSLRPEACRPAAGGAVHTRGL DFACDFWVLVVVGGVLACYSLLVTVAFIIFWVKRGRKKLLYIFKQPFM RPVQTTQEEDGCSCRFPEEEEGGCELRVKFSRSADAPAYQQGQNQLYN ELNLGRREEYDVLDKRRGRDPEMGGKPRRKNPQEGLYNELQKDKMAEA YSEIGMKGERRRGKGHDGLYQGLSTATKDTYDALHMQALPPR |
| 12 | SR8: IL13 mutein-HER2 (4D5 #5) | MALPVTALLLPLALLLHAARPSPGPVPPSTALRYLIEELVNITQNQKA PLCNGSMVWSINLTAGMYCAALESLINVSGCSAIEKTQRMLSGFCPHK VSAGQFSSLHVRDTKIEVAQFVKDLLLHLKKLFREGRFNGGGGSGGGG SGGGGSDIQMTQSPSSLSASVGDRVTITCRASQDVNTAVAWYQQKPGK APKLLIYSASFLESGVPSRFSGSRSGTDFTLTISSLQPEDFATYYCQQ HYTTPPTFGQGTKVEIKGGGGSGGGGSGGGGSEVQLVESGGGLVQPGG SLRLSCAASGFNIKDTYIHWVRQAPGKGLEWVARIYPTNGYTRYADSV KGRFTISADTSKNTAYLQMNSLRAEDTAVYYCSRWGGDGFYAMDVWGQ GTLVTVSSTTTPAPRPPTPAPTIASQPLSLRPEACRPAAGGAVHTRGL DFACDFWVLVVVGGVLACYSLLVTVAFIIFWVKRGRKKLLYIFKQPFM RPVQTTQEEDGCSCRFPEEEEGGCELRVKFSRSADAPAYQQGQNQLYN ELNLGRREEYDVLDKRRGRDPEMGGKPRRKNPQEGLYNELQKDKMAEA YSEIGMKGERRRGKGHDGLYQGLSTATKDTYDALHMQALPPR |

TABLE 1-continued

Non-limiting Examples of Amino Acid Sequences
of Dual-CAR Constructs and Components Thereof

| SEQ ID NO: | Name | Amino Acid Sequence |
|---|---|---|
| 13 | SR9: IL13 mutein-HER2 (4D5 #8) | MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |

TABLE 2

Non-limiting Examples of Amino Acid Sequences
of BiTE Constructs or Components Thereof

| SEQ ID NO: | Name | | Amino Acid Sequence |
|---|---|---|---|
| 14 | scFv CD3e | | DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK |
| 15 | Vhh | 7D12 | QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS |
| 16 | | 9G8 | EVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSS |
| 17 | | 38G7 | EVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS |
| 18 | linker | | GGGGS |
| 19 | signal peptide | | METDTLLLWVLLLWVPGSTGD |
| 20 | 6xHis | | HHHHHH |
| 21 | SR10: Vhh_7D12-CD3e | | METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH |
| 22 | SR11: Vhh_9G8-CD3e | | METDTLLLWVLLLWVPGSTGDEVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH |
| 23 | SR12: Vhh_38G7-CD3e | | METDTLLLWVLLLWVPGSTGDEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH |

TABLE 2-continued

Non-limiting Examples of Amino Acid Sequences
of BiTE Constructs or Components Thereof

| SEQ ID NO: | Name | Amino Acid Sequence |
|---|---|---|
| 24 | SR15: Vhh-Vhh_7D12-9G8-CD3e | METDTLLLWVLLLWVPGSTGDQVKLEESGGGSVQTGGSLRLTCAASGRTSRSYGMGWFRQAPGKE REFVSGISWRGDSTGYADSVKGRFTISRDNAKNTVDLQMNSLKPEDTAIYYCAAAGSAWYGTLY EYDYWGQGTQVTVSSGGGGSGGGGSGGGGSEVQLVESGGGLVQAGGSLRLSCAASGRTFSSYAMG WFRQAPGKEREFVVAINWSSGSTYYADSVKGRFTISRDNAKNTMYLQMNSLKPEDTAVYYCAAGY QINSGNYNFKDYEYDYWGQGTQVTVSSGGGGSDIKLQQSGAELARPGASVKMSCKTSGYTFTRYT MHWVKQRPGQGLEWIGYINPSRGYTNYNQKFKDKATLTTDKSSSTAYMQLSSLTSEDSAVYYCAR YYDDHYCLDYWGQGTTLTVSSVEGGSGGSGGSGSGGVDDIQLTQSPAIMSASPGEKVTMTCRAS SSVSYMNWYQQKSGTSPKRWIYDTSKVASGVPYRFSGSGSGTSYSLTISSMEAEDAATYYCQQWS SNPLTFGAGTKLELKHHHHHH |
| 25 | SR16: Vhh-Vhh_7D12-38G7-CD3e | METDTLLLWVLLLWVPGSTGDQVKLEESGGGSVQTGGSLRLTCAASGRTSRSYGMGWFRQAPGKE REFVSGISWRGDSTGYADSVKGRFTISRDNAKNTVDLQMNSLKPEDTAIYYCAAAGSAWYGTLY EYDYWGQGTQVTVSSGGGGSGGGGSGGGGSEVQLVESGGGLVQAGGSLRLSCAASGRTFSSYVMG WFRQATGKEREFVATIAWDSGSTYYADSVKGRFTISRDNAKNTVHLQMNSLKPEDTAVYYCAASY NVYYNNYYPISRDEYDYWGQGTQVTVSSGGGGSDIKLQQSGAELARPGASVKMSCKTSGYTFTR YTMHWVKQRPGQGLEWIGYINPSRGYTNYNQKFKDKATLTTDKSSSTAYMQLSSLTSEDSAVYYC ARYYDDHYCLDYWGQGTTLTVSSVEGGSGGSGGSGGSGGVDDIQLTQSPAIMSASPGEKVTMTCR ASSSVSYMNWYQQKSGTSPKRWIYDTSKVASGVPYRFSGSGSGTSYSLTISSMEAEDAATYYCQQ WSSNPLTFGAGTKLELKHHHHHH |
| 26 | SR17: Vhh_7D12-CD3e-9G8_Vhh | METDTLLLWVLLLWVPGSTGDQVKLEESGGGSVQTGGSLRLTCAASGRTSRSYGMGWFRQAPGKE REFVSGISWRGDSTGYADSVKGRFTISRDNAKNTVDLQMNSLKPEDTAIYYCAAAGSAWYGTLY EYDYWGQGTQVTVSSGGGGSDIKLQQSGAELARPGASVKMSCKTSGYTFTRYTMHWVKQRPGQGL EWIGYINPSRGYTNYNQKFKDKATLTTDKSSSTAYMQLSSLTSEDSAVYYCARYYDDHYCLDYWG QGTTLTVSSVEGGSGGSGGSGGSGGVDDIQLTQSPAIMSASPGEKVTMTCRASSSVSYMNWYQQK SGTSPKRWIYDTSKVASGVPYRFSGSGSGTSYSLTISSMEAEDAATYYCQQWSSNPLTFGAGTKL ELKGGGGSEVQLVESGGGLVQAGGSLRLSCAASGRTFSSYAMGWFRQAPGKEREFVVAINWSSGS TYYADSVKGRFTISRDNAKNTMYLQMNSLKPEDTAVYYCAAGYQINSGNYNFKDYEYDYWGQGTQ VTVSSHHHHHH |
| 27 | SR18: Vhh_7D12-CD3e-38G7_Vhh | METDTLLLWVLLLWVPGSTGDQVKLEESGGGSVQTGGSLRLTCAASGRTSRSYGMGWFRQAPGKE REFVSGISWRGDSTGYADSVKGRFTISRDNAKNTVDLQMNSLKPEDTAIYYCAAAGSAWYGTLY EYDYWGQGTQVTVSSGGGGSDIKLQQSGAELARPGASVKMSCKTSGYTFTRYTMHWVKQRPGQGL EWIGYINPSRGYTNYNQKFKDKATLTTDKSSSTAYMQLSSLTSEDSAVYYCARYYDDHYCLDYWG QGTTLTVSSVEGGSGGSGGSGGSGGVDDIQLTQSPAIMSASPGEKVTMTCRASSSVSYMNWYQQK SGTSPKRWIYDTSKVASGVPYRFSGSGSGTSYSLTISSMEAEDAATYYCQQWSSNPLTFGAGTKL ELKGGGGSEVQLVESGGGLVQAGGSLRLSCAASGRTFSSYVMGWFRQATGKEREFVATIAWDSGS TYYADSVKGRFTISRDNAKNTVHLQMNSLKPEDTAVYYCAASYNVYYNNYYPISRDEYDYWGQG TQVTVSSHHHHHH |

TABLE 3

Non-limiting Examples of Amino Acid Sequences
of Dual-CAR/BiTEs or Components Thereof

| SEQ ID NO: | Amino Acid Sequences |
|---|---|
| 28 | Self-cleaving T2A Peptide<br>GSGEGRGSLLTCGDVEENPGP |
| 29 | Cetuximab (anti-EGFR)<br>DILLTQSPVILSVSPGERVSFSCRASQSIGTNIHWYQQRTNGSPRLLIKYASESISGIPSRFSGSGSGTDFTLSINS VESEDIADYYCQQNNNWPTTFGAGTKLELKGGGGSGGGGSGGGGSQVQLKQSGPGLVQPSQSLSITCTVSGFSLTNY GVHWVRQSPGKGLEWLGVIWSGGNTDYNTPFTSRLSINKDNSKSQVFFKMNSLQSNDTAIYYCARALTYYDYEFAYW GQGTLVTVSA |
| 30 | anti-CD19_Blinatumomab<br>DIQLTQSPASLAVSLGQRATISCKASQSVDYDGDSYLNWYQQIPGQPPKLLIYDASNLVSGIPPRFSGSGSGTDFTL NIHPVEKVDAATYHCQQSTEDPWTFGGGTKLEIKGGGGSGGGGSGGGGSQVQLQQSGAELVRPGSSVKISCKASGYA FSSYWMNWVKQRPGQGLEWIGQIWPGDGDTNYNGKFKGKATLTADESSSTAYMQLSSLASEDSAVYFCARRETTTVG RYYYAMDYWGQGTTVTVSS |
| 31 | SR20: IL13 mutein-HER2(4D5 #2)_scFv(anti-EGFR_cetuximab)-scFv(CD3e)<br>MALPVTALLLPLALLLHAARPSPGPVPPSTALRYLIEELVNITQNQKAPLCNGSMVWSINLTAGMYCAALESLINVS GCSALEKTQRWILSGFCPHKVSAGQFSSLHVRDTKIEVAQFVKDLLLHLKKLFREGRFNGGGGSGGGGSGGGGSDIQ MTQSPSSLSASVGDRVTITCRASQDVNTAVAWYQQKPGKAPKLLIYSASFLESGVPSRFSGSGSGTDFTLTISSLQP EDFATYYCQQHYTTPPTFGQGTKVEIKGGGGSGGGGSGGGGSEVQLVESGGGLVQPGGSLRLSCAASGFNIKDTYIH |

TABLE 3-continued

Non-limiting Examples of Amino Acid Sequences
of Dual-CAR/BiTEs or Components Thereof

| SEQ ID NO: | Amino Acid Sequences |
|---|---|
|  | WVRQAPGKGLEWVARIYPTNGYTRYADSVKGRFTISADDSKNTLYLQMNSLRAEDTAVYYCARWGGDGFYAMDVWGQ<br>GTLVTVSSTTTPAPRPPTPAPTIASQPLSLRPEACRPAAGGAVHTRGLDFACDFWVLVVVGGVLACYSLLVTVAFII<br>FWVKRGRKKLLYIFKQPFMRPVQTTQEEDGCSCRFPEEEEGGCELRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTATKDTYDALHMQAL<br>PPRGSGEGRGSLLTCGDVEENPGPMETDTLLLWVLLLWVPGSTGDDILLTQSPVILSVSPGERVSFSCRASQSIGTN<br>IHWYQQRTNGSPRLLIKYASESISGIPSRFSGSGSGTDFTLSINSVESEDIADYYCQQNNNWPTTFGAGTKLELKGG<br>GGSGGGGSGGGGSQVQLKQSGPGLVQPSQSLSITCTVSGFSLTNYGVHWVRQSPGKGLEWLGVIWSGGNTDYNTPFT<br>SRLSINKDNSKSQVFFKMNSLQSNDTAIYYCARALTYYDYEFAYWGQGTLVTVSAGGGGSDIKLQQSGAELARPGAS<br>VKMSCKTSGYTFTRYTMHWVKQRPGQGLEWIGYINPSRGYTNYNQKFKDKATLTTDKSSSTAYMQLSSLTSEDSAVY<br>YCARYYDDHYCLDYWGQGTTLTVSSVEGGSGGSGGSGGSGGVDDIQLTQSPAIMSASPGEKVTMTCRASSSVSYMNW<br>YQQKSGTSPKRWIYDTSKVASGVPYRFSGSGSGTSYSLTISSMEAEDAATYYCQQWSSNPLTFGAGTKLELKHHHHH<br>H |
| 32 | SR21: IL13 mutein-HER2(4D5 #2)_Vhh(anti-EGFR_7D12)-scFv(CD3e)<br>MALPVTALLLPLALLLHAARPSPGPVPPSTALRYLIEELVNITQNQKAPLCNGSMVWSINLTAGMYCAALESLINVS<br>GCSALEKTQRWILSGFCPHKVSAGQFSSLHVRDTKIEVAQFVKDLLLHLKKLFREGRFNGGGGSGGGGSGGGGSDIQ<br>MTQSPSSLSASVGDRVTITCRASQDVNTAVAWYQQKPGKAPKLLIYSASFLESGVPSRFSGSGSGTDFTLTISSLQP<br>EDFATYYCQQHYTTPPTFGQGTKVEIKGGGGSGGGGSGGGGSEVQLVESGGGLVQPGGSLRLSCAASGFNIKDTYIH<br>WVRQAPGKGLEWVARIYPTNGYTRYADSVKGRFTISADDSKNTLYLQMNSLRAEDTAVYYCARWGGDGFYAMDVWGQ<br>GTLVTVSSTTTPAPRPPTPAPTIASQPLSLRPEACRPAAGGAVHTRGLDFACDFWVLVVVGGVLACYSLLVTVAFII<br>FWVKRGRKKLLYIFKQPFMRPVQTTQEEDGCSCRFPEEEEGGCELRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTATKDTYDALHMQAL<br>PPRGSGEGRGSLLTCGDVEENPGPMETDTLLLWVLLLWVPGSTGDQVKLEESGGGSVQTGGSLRLTCAASGRTSRSY<br>GMGWFRQAPGKEREFVSGISWRGDSTGYADSVKGRFTISRDNAKNTVDLQMNSLKPEDTAIYYCAAAAGSAWYGTLY<br>EYDYWGQGTQVTVSSGGGGSDIKLQQSGAELARPGASVKMSCKTSGYTFTRYTMHWVKQRPGQGLEWIGYINPSRGY<br>TNYNQKFKDKATLTTDKSSSTAYMQLSSLTSEDSAVYYCARYYDDHYCLDYWGQGTTLTVSSVEGGSGGSGGSGGSG<br>GVDDIQLTQSPAIMSASPGEKVTMTCRASSSVSYMNWYQQKSGTSPKRWIYDTSKVASGVPYRFSGSGSGTSYSLTI<br>SSMEAEDAATYYCQQWSSNPLTFGAGTKLELKHHHHHH |
| 33 | SR22: IL13 mutein-HER2(4D5 #2)_Vhh(anti-EGFR_7D12)-scFv(CD3e)-<br>Vhh(anti-EGFR_38G7)<br>MALPVTALLLPLALLLHAARPSPGPVPPSTALRYLIEELVNITQNQKAPLCNGSMVWSINLTAGMYCAALESLINVS<br>GCSALEKTQRWILSGFCPHKVSAGQFSSLHVRDTKIEVAQFVKDLLLHLKKLFREGRFNGGGGSGGGGSGGGGSDIQ<br>MTQSPSSLSASVGDRVTITCRASQDVNTAVAWYQQKPGKAPKLLIYSASFLESGVPSRFSGSGSGTDFTLTISSLQP<br>EDFATYYCQQHYTTPPTFGQGTKVEIKGGGGSGGGGSGGGGSEVQLVESGGGLVQPGGSLRLSCAASGFNIKDTYIH<br>WVRQAPGKGLEWVARTYPTNGYTRYADSVKGRFTISADDSKNTLYLQMNSLRAEDTAVYYCARWGGDGFYAMDVWGQ<br>GTLVTVSSTTTPAPRPPTPAPTIASQPLSLRPEACRPAAGGAVHTRGLDFACDFWVLVVVGGVLACYSLLVTVAFII<br>FWVKRGRKKLLYIFKQPFMRPVQTTQEEDGCSCRFPEEEEGGCELRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTATKDTYDALHMQAL<br>PPRGSGEGRGSLLTCGDVEENPGPMETDTLLLWVLLLWVPGSTGDQVKLEESGGGSVQTGGSLRLTCAASGRTSRSY<br>GMGWFRQAPGKEREFVSGISWRGDSTGYADSVKGRFTISRDNAKNTVDLQMNSLKPEDTAIYYCAAAAGSAWYGTLY<br>EYDYWGQGTQVTVSSGGGGSDIKLQQSGAELARPGASVKMSCKTSGYTFTRYTMHWVKQRPGQGLEWIGYINPSRGY<br>TNYNQKFKDKATLTTDKSSSTAYMQLSSLTSEDSAVYYCARYYDDHYCLDYWGQGTTLTVSSVEGGSGGSGGSGGSG<br>GVDDIQLTQSPAIMSASPGEKVTMTCRASSSVSYMNWYQQKSGTSPKRWIYDTSKVASGVPYRFSGSGSGTSYSLTI<br>SSMEAEDAATYYCQQWSSNPLTFGAGTKLELKGGGGSEVQLVESGGGLVQAGGSLRLSCAASGRTFSSYVMGWFRQA<br>TGKEREFVATIAWDSGSTYYADSVKGRFTISRDNAKNTVHLQMNSLKPEDTAVYYCAASYNVYYNNYYYPISRDEYD<br>YWGQGTQVTVSSHHHHHH |
| 34 | SR23: IL13 mutein-HER2(4D5 #2)_scFv(anti-CD19_Blinatumomab)-scFv(CD3e)<br>MALPVTALLLPLALLLHAARPSPGPVPPSTALRYLIEELVNITQNQKAPLCNGSMVWSINLTAGMYCAALESLINVS<br>GCSALEKTQRWILSGFCPHKVSAGQFSSLHVRDTKIEVAQFVKDLLLHLKKLFREGRFNGGGGSGGGGSGGGGSDIQ<br>MTQSPSSLSASVGDRVTITCRASQDVNTAVAWYQQKPGKAPKLLIYSASFLESGVPSRFSGSGSGTDFTLTISSLQP<br>EDFATYYCQQHYTTPPTFGQGTKVEIKGGGGSGGGGSGGGGSEVQLVESGGGLVQPGGSLRLSCAASGFNIKDTYIH<br>WVRQAPGKGLEWVARTYPTNGYTRYADSVKGRFTISADDSKNTLYLQMNSLRAEDTAVYYCARWGGDGFYAMDVWGQ<br>GTLVTVSSTTTPAPRPPTPAPTIASQPLSLRPEACRPAAGGAVHTRGLDFACDFWVLVVVGGVLACYSLLVTVAFII<br>FWVKRGRKKLLYIFKQPFMRPVQTTQEEDGCSCRFPEEEEGGCELRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTATKDTYDALHMQAL<br>PPRGSGEGRGSLLTCGDVEENPGPMETDTLLLWVLLLWVPGSTGDDIQLTQSPASLAVSLGQRATISCKASQSVDYD<br>GDSYLNWYQQIPGQPPKLLIYDASNLVSGIPPRFSGSGSGTDFTLNIHPVEKVDAATYHCQQSTEDPWTFGGGTKLE<br>IKGGGGSGGGGSGGGGSQVQLQQSGAELVRPGSSVKISCKASGYAFSSYWMNWVKQRPGQGLEWIGQIWPGDGDTNY<br>NGKFKGKATLTADESSSTAYMQLSSLASEDSAVYFCARRETTTVGRYYYAMDYWGQGTTVTVSSGGGGSDIKLQQSG<br>AELARPGASVKMSCKTSGYTFTRYTMHWVKQRPGQGLEWIGYINPSRGYTNYNQKFKDKATLTTDKSSSTAYMQLSS<br>LTSEDSAVYYCARYYDDHYCLDYWGQGTTLTVSSVEGGSGGSGGSGGSGGVDDIQLTQSPAIMSASPGEKVTMTCRA<br>SSSVSYMNWYQQKSGTSPKRWIYDTSKVASGVPYRFSGSGSGTSYSLTISSMEAEDAATYYCQQWSSNPLTFGAGTK<br>LELKHHHHHH |
| 35 | SR24: IL13 mutein-HER2(4D5 #8)_scFv(anti-EGFR_cetuximab)-scFv(CD3e)<br>MALPVTALLLPLALLLHAARPSPGPVPPSTALRYLIEELVNITQNQKAPLCNGSMVWSINLTAGMYCAALESLINVS<br>GCSALEKTQRMLSGFCPHKVSAGQFSSLHVRDTKIEVAQFVKDLLLHLKKLFREGRFNGGGGSGGGGSGGGGSDIQM<br>TQSPSSLSASVGDRVTITCRASQDVNTAVAWYQQKPGKAPKLLIYSASFLYSGVPSRFSGSRSGTDFTLTISSLQPE<br>DFATYYCQQHYTTPPTFGQGTKVEIKGGGGSGGGGSGGGGSEVQLVESGGGLVQPGGSLRLSCAASGFNIKDTYIHW<br>VRQAPGKGLEWVARTYPTNGYTRYADSVKGRFTISADTSKNTAYLQMNSLRAEDTAVYYCSRWGGDGFYAMDYWGQG<br>TLVTVSSTTTPAPRPPTPAPTIASQPLSLRPEACRPAAGGAVHTRGLDFACDFWVLVVVGGVLACYSLLVTVAFIIF |

TABLE 3-continued

Non-limiting Examples of Amino Acid Sequences
of Dual-CAR/BiTEs or Components Thereof

| SEQ ID NO: | Amino Acid Sequences |
|---|---|
| | WVKRGRKKLLYIFKQPFMRPVQTTQEEDGCSCRFPEEEEGGCELRVKFSRSADAPAYQQGQNQLYNELNLGRREEYD VLDKRRGRDPEMGGKPRRKNPQEGLYNELQKDKMAEAYSEIGMKGERRRGKHDGLYQGLSTATKDTYDALHMQALP PRGSGEGRGSLLTCGDVEENPGPMETDTLLLWVLLLWVPGSTGDDILLTQSPVILSVSPGERVSFSCRASQSIGTNI HWYQQRTNGSPRLLIKYASESISGIPSRFSGSGSGTDFTLSINSVESEDIADYYCQQNNNWPTTFGAGTKLELKGGG GSGGGGSGGGGSQVQLKQSGPGLVQPSQSLSITCTVSGFSLTNYGVHWVRQSPGKGLEWLGVIWSGGNTDYNTPFTS RLSINKDNSKSQVFFKMNSLQSNDTAIYYCARALTYYDYEFAYWGQGTLVTVSAGGGGSDIKLQQSGAELARPGASV KMSCKTSGYTFTRYTMHWVKQRPGQGLEWIGYINPSRGYTNYNQKFKDKATLTTDKSSSTAYMQLSSLTSEDSAVYY CARYYDDHYCLDYWGQGTTLTVSSVEGGSGGSGGSGGSGGVDDIQLTQSPAIMSASPGEKVTMTCRASSSVSYMNWY QQKSGTSPKRWIYDTSKVASGVPYRFSGSGSGTSYSLTISSMEAEDAATYYCQQWSSNPLTFGAGTKLELKHHHHHH |
| 36 | SR25: IL13 mutein-HER2(4D5 #8)_Vhh(anti-EGFR_7D12)-scFv(CD3e) MALPVTALLLPLALLLHAARPSPGPVPPSTALRYLIEELVNITQNQKAPLCNGSMVWSINLTAGMYCAALESLINVS GCSAIEKTQRMLSGFCPHKVSAGQFSSLHVRDTKIEVAQFVKDLLLHLKKLFREGRFNGGGGSGGGGSGGGGSDIQM TQSPSSLSASVGDRVTITCRASQDVNTAVAWYQQKPGKAPKLLIYSASFLYSGVPSRFSGSRSGTDFTLTISSLQPE DFATYYCQQHYTTPPTFGQGTKVEIKGGGGSGGGGSGGGGSEVQLVESGGGLVQPGGSLRLSCAASGFNIKDTYIHW VRQAPGKGLEWVARIYPTNGYTRYADSVKGRFTISADTSKNTAYLQMNSLRAEDTAVYYCSRWGGDGFYAMDYWGQG TLVTVSSTTTPAPRPPTPAPTIASQPLSLRPEACRPAAGGAVHTRGLDFACDFWVLVVVGGVLACYSLLVTVAFIIF WVKRGRKKLLYIFKQPFMRPVQTTQEEDGCSCRFPEEEEGGCELRVKFSRSADAPAYQQGQNQLYNELNLGRREEYD VLDKRRGRDPEMGGKPRRKNPQEGLYNELQKDKMAEAYSEIGMKGERRRGKHDGLYQGLSTATKDTYDALHMQALP PRGSGEGRGSLLTCGDVEENPGPMETDTLLLWVLLLWVPGSTGDQVKLEESGGGSVQTGGSLRLTCAASGRTSRSYG MGWFRQAPGKEREFVSGISWRGDSTGYADSVKGRFTISRDNAKNTVDLQMNSLKPEDTAIYYCAAAAGSAWYGTLYE YDYWGQGTQVTVSSGGGGSDIKLQQSGAELARPGASVKMSCKTSGYTFTRYTMHWVKQRPGQGLEWIGYINPSRGYT NYNQKFKDKATLTTDKSSSTAYMQLSSLTSEDSAVYYCARYYDDHYCLDYWGQGTTLTVSSVEGGSGGSGGSGGSGG VDDIQLTQSPAIMSASPGEKVTMTCRASSSVSYMNWYQQKSGTSPKRWIYDTSKVASGVPYRFSGSGSGTSYSLTIS SMEAEDAATYYCQQWSSNPLTFGAGTKLELKHHHHHH |
| 37 | SR26: IL13 mutein-HER2(4D5 #8)_Vhh(anti-EGFR_7D12)-scFv(CD3e)-Vhh(anti-EGFR_38G7) MALPVTALLLPLALLLHAARPSPGPVPPSTALRYLIEELVNITQNQKAPLCNGSMVWSINLTAGMYCAALESLINVS GCSALEKTQRMLSGFCPHKVSAGQFSSLHVRDTKIEVAQFVKDLLLHLKKLFREGRFNGGGGSGGGGSGGGGSDIQM TQSPSSLSASVGDRVTITCRASQDVNTAVAWYQQKPGKAPKLLIYSASFLYSGVPSRFSGSRSGTDFTLTISSLQPE DFATYYCQQHYTTPPTFGQGTKVEIKGGGGSGGGGSGGGGSEVQLVESGGGLVQPGGSLRLSCAASGFNIKDTYIHW VRQAPGKGLEWVARTYPTNGYTRYADSVKGRFTISADTSKNTAYLQMNSLRAEDTAVYYCSRWGGDGFYAMDYWGQG TLVTVSSTTTPAPRPPTPAPTIASQPLSLRPEACRPAAGGAVHTRGLDFACDFWVLVVVGGVLACYSLLVTVAFIIF WVKRGRKKLLYIFKQPFMRPVQTTQEEDGCSCRFPEEEEGGCELRVKFSRSADAPAYQQGQNQLYNELNLGRREEYD VLDKRRGRDPEMGGKPRRKNPQEGLYNELQKDKMAEAYSEIGMKGERRRGKHDGLYQGLSTATKDTYDALHMQALP PRGSGEGRGSLLTCGDVEENPGPMETDTLLLWVLLLWVPGSTGDQVKLEESGGGSVQTGGSLRLTCAASGRTSRSYG MGWFRQAPGKEREFVSGISWRGDSTGYADSVKGRFTISRDNAKNTVDLQMNSLKPEDTAIYYCAAAAGSAWYGTLYE YDYWGQGTQVTVSSGGGGSDIKLQQSGAELARPGASVKMSCKTSGYTFTRYTMHWVKQRPGQGLEWIGYINPSRGYT NYNQKFKDKATLTTDKSSSTAYMQLSSLTSEDSAVYYCARYYDDHYCLDYWGQGTTLTVSSVEGGSGGSGGSGGSGG VDDIQLTQSPAIMSASPGEKVTMTCRASSSVSYMNWYQQKSGTSPKRWIYDTSKVASGVPYRFSGSGSGTSYSLTIS SMEAEDAATYYCQQWSSNPLTFGAGTKLELKGGGGSEVQLVESGGGLVQAGGSLRLSCAASGRTFSSYVMGWFRQAT GKEREFVATIAWDSGSTYYADSVKGRFTISRDNAKNTVHLQMNSLKPEDTAVYYCAASYNVYYNNYYYPISRDEYDY WGQGTQVTVSSHHHHHH |
| 38 | SR27: IL13 mutein-HER2(4D5 #8)_scFv(anti-CD19_Blinatumomab)-scFv(CD3e) MALPVTALLLPLALLLHAARPSPGPVPPSTALRYLIEELVNITQNQKAPLCNGSMVWSINLTAGMYCAALESLINVS GCSAIEKTQRMLSGFCPHKVSAGQFSSLHVRDTKIEVAQFVKDLLLHLKKLFREGRFNGGGGSGGGGSGGGGSDIQM TQSPSSLSASVGDRVTITCRASQDVNTAVAWYQQKPGKAPKLLIYSASFLYSGVPSRFSGSRSGTDFTLTISSLQPE DFATYYCQQHYTTPPTFGQGTKVEIKGGGGSGGGGSGGGGSEVQLVESGGGLVQPGGSLRLSCAASGFNIKDTYIHW VRQAPGKGLEWVARTYPTNGYTRYADSVKGRFTISADTSKNTAYLQMNSLRAEDTAVYYCSRWGGDGFYAMDYWGQG TLVTVSSTTTPAPRPPTPAPTIASQPLSLRPEACRPAAGGAVHTRGLDFACDFWVLVVVGGVLACYSLLVTVAFIIF WVKRGRKKLLYIFKQPFMRPVQTTQEEDGCSCRFPEEEEGGCELRVKFSRSADAPAYQQGQNQLYNELNLGRREEYD VLDKRRGRDPEMGGKPRRKNPQEGLYNELQKDKMAEAYSEIGMKGERRRGKHDGLYQGLSTATKDTYDALHMQALP PRGSGEGRGSLLTCGDVEENPGPMETDTLLLWVLLLWVPGSTGDDIQLTQSPASLAVSLGQRATISCKASQSVDYDG DSYLNWYQQIPGQPPKLLIYDASNLVSGIPPRFSGSGSGTDFTLNIHPVEKVDAATYHCQQSTEDPWTFGGGTKLEI KGGGGSGGGGSGGGGSQVQLQQSGAELVRPGSSVKISCKASGYAFSSYWMNWVKQRPGQGLEWIGQIWPGDGTNYN GKFKGKATLTADESSSTAYMQLSSLASEDSAVYFCARRETTTVGRYYYAMDYWGQGTTVTVSSGGGGSDIKLQQSGA ELARPGASVKMSCKTSGYTFTRYTMHWVKQRPGQGLEWIGYINPSRGYTNYNQKFKDKATLTTDKSSSTAYMQLSSL TSEDSAVYYCARYYDDHYCLDYWGQGTTLTVSSVEGGSGGSGGSGGSGGVDDIQLTQSPAIMSASPGEKVTMTCRAS SSVSYMNWYQQKSGTSPKRWIYDTSKVASGVPYRFSGSGSGTSYSLTISSMEAEDAATYYCQQWSSNPLTFGAGTKL ELKHHHHHH |

TABLE 4

Structure Components of the Constructs Used in FIGS. 1-26

| Clone # | Detail Structure |
|---|---|
| SR6 | IL13 mutein-HER2 (FRP5) |
| SR7 | IL13 mutein-HER2 (4D5, #2) |
| SR8 | IL13 mutein-HER2 (4D5, #5) |
| SR9 | IL13 mutein-HER2 (4D5, #8) |
| SR10 | 7D12_EGFR.BiTE |
| SR11 | 9G8_EGFR.BiTE |
| SR12 | 38G7_EGFR.BiTE |
| SR13 | Cetuximab_EGFR.BiTE |
| SR14 | Blinatumomab_CD19.BiTE |
| SR15 | 7D12 9G8-CD3_EGFR.BiTE |
| SR16 | 7D12 38G7-CD3_EGFR.BiTE |
| SR17 | 7D12-CD3-9G8_EGFR.BiTE |
| SR18 | 7D12-CD3-38G7_EGFR.BiTE |
| SR19 | Parent vector with GFP |
| SR20 | IL13 mutein-HER2 (4D5, #2)-Cetuximab_EGFR.BiTE |
| SR21 | IL13 mutein-HER2 (4D5, #2)-7D12_EGFR.BiTE |
| SR22 | IL13 mutein-HER2 (4D5, #2)-7D12-CD3-38G7_EGFR.BiTE |
| SR23 | IL13 mutein-HER2 (4D5, #2)-Blinatumomab_CD19.BiTE |
| SR24 | IL13 mutein-HER2 (4D5, #8)-Cetuximab_EGFR.BiTE |
| SR25 | IL13 mutein-HER2 (4D5, #8)-7D12_EGFR.BiTE |
| SR26 | IL13 mutein-HER2 (4D5, #8)-7D12-CD3-38G7_EGFR.BiTE |
| SR27 | IL13 mutein-HER2 (4D5, #8)-Blinatumomab_CD19.BiTE |

TABLE 5

Materials

| Vendor | Catalog # | Description |
|---|---|---|
| PeproTech, Inc. | 200-02-1MG | Recombinant Human IL-2 |
| Lonza Group | BE02-053Q | X-VIVO ™ 15 Serum-free Hematopoietic Cell Medium |
| Stemcell Technologies | 7930 | CryoStor ® CS10 |
| Sigma-Aldrich | 92090213-1VL | T98G Cell Line human |
| Thermo Fisher Scientific | 12648010 | Gibco Recovely ™ Cell Culture Freezing Medium |
| ATCC | 30-2020 | Fetal Bovine Serum |
| Thermo Fisher Scientific | 11132D | Dynabeads ™ Human T-Activator CD3/CD28 for T Cell Expansion and Activation |
| Thermo Fisher Scientific | 31-985-062 | Gibco ™ Opti-MEM ™ I Reduced Serum Medium |
| ATCC | 30-2005 | IMDM |
| BioLegend | 324404 | FITC anti-human CD340 (erbB2/HER-2) Antibody |
| BioLegend | 352904 | PE anti-human EGFR Antibody |
| BioLegend | 354406 | APC anti-human CD213a2 (IL13Rα2) Antibody |
| EMD Millipore | SE1M003M00 | Steriflip-HV Sterile Centrifuge Tube Top Filter Unit |
| Mirus Bio | MIR 6700 | TransIT-VirusGEN ® Transfection Reagent |
| Cellomics Technology | PLV-10172-50 | Firefly luciferase-GFP lentivirus (CMV, Puro) (2x25 ul) |
| Thermo Fisher Scientific | 10569044 | Gibco DMEM, high glucose, GlutaMAX ™ Supplement, pyruvate |
| Thermo Fisher Scientific | 12563011 | Gibco TrypLE ™ Select Enzyme (1X), no phenol red |
| BPS Bio science | 60621 | NFAT Reporter (Luc)-Jurkat Cell line |
| ACROBiosystems | IL2-HF2H3-25ug-290 | FITC-Labeled Human IL-13 R alpha 2 Protein, His Tag |
| G&P Biosciences | LTV-HER2 (SKU#: LTV0220) | Human HER2 Lentivirus, full-length gene in lentivector, pre-packaged lentiviral particles |
| G&P Biosciences | LTV-IL13RA2 (SKU#: LTV2454) | Human IL13RA2/CD213a2/IL13BP/IL13R2 Lentivirus, Pre-packaged Lentiviral Particles |
| R&D Systems, Inc. | D2050 | Human IL-2 Quantikine ELISA Kit |
| R&D Systems, Inc. | DIF50 | Human IFN-gamma Quantikine ELISA Kit |
| BPS Bioscience | Catalog #60690-1 | ONE-Step ™ Luciferase Assay System |
| ACROBiosystems | HE2-HF224-25ug | FITC-Labeled Human Her2/ErbB2 Protein, His Tag |
| BioLegend | 352919 | BV711 anti-human EGFR |
| BioLegend | 354405 | APC anti-human CD213a2 (IL13Ra2) |
| BioLegend | 324420 | BV421 anti-human CD340 (erbB2/HER-2) |
| Lonza Group | V4XC-1024 | SE Cell Line 4D-Nucleofector X Kit L |
| Thermo Fisher Scientific | A1049101 | RPMI-1640 Medium |
| PerkinElmer | 122799 | XenoLight D-Luciferin-K$^+$ Salt Bioluminescent Substrate |
| Biolegend | 317344 | BV421 anti-human CD3 Antibody |
| Biolegend | 344722 | APC anti-human CD8 Antibody |
| Biolegend | 357404 | PE anti-human CD4 Antibody |
| GenScript Biotech | L00436 | His Tag ELISA Detection Kit |
| BPS Bioscience | 60690-2 | ONE-Step ™ Luciferase Assay System |
| Lifespan Biosciences | LS-F55748-1 | His Tag (Competitive EIA) ELISA Kit |
| ACEA Biosciences, Inc. | 6472451001 | E-Plate VIEW 96 |
| Patterson Veterinary Supply, Inc. | 07-893-1389 | Isoflurane |
| Braintree Scientific, Inc. | AB-1 | Gas Anesthetizing Box |
| Jackson Laboratory | 005557 | NSG mice: NOD scid gamma |
| Spectral Instruments | A1854 | Ami HT |
| Spectral Instruments | AVL | Aura |
| Colonial Medical Supply | 905300 | Isoflurane Machine |
| Colonial Medical Supply | 941444 | Induction Chamber |
| Ohaus Corporation | SPX622 | Scout Scale |
| Kopf Instruments | Model 940 | Small Animal Stereotaxic Instrument with Digital Display Console |

TABLE 6

Primers and probes sequences

| SEQ ID | Sequence name | Sequence |
|---|---|---|
| Set 1 | | |
| NO: 41 | HC HER2 ScFv-HD2 FWD | AGCAAGAACACCGCCTATC |
| NO: 42 | HC HER2 ScFv-HD2 REV | CCAATAGTCCATGGCGTAGAA |
| NO: 43 | HC HER2 ScFv-HD2 PRB | /56-FAM/AGAGCCGAA/ZEN/GATACAGCCGTCTACT/3IABkFQ/ |
| Set 3 | | |
| NO: 44 | 7D12 VHH-HD3 FWD | GCAAGGAGAGGGAGTTTGT |
| NO: 45 | 7D12 VHH-HD3 REV | GTCTTCGGGCTTCAGAGAAT |
| NO: 46 | 7D12 VHH-HD3 PRB | /56-FAM/AAACCTTCC/ZEN/CTTCACGGAGTCAGC/3IABkFQ/ |

TABLE 7 qPCR Reaction

| Component | Final Concentration | Volume |
|---|---|---|
| PrimeTime Gene Expression Master Mix (2x) | 1x | 10 μl |
| Forward Primer | 1 μM | 2 μl |
| Reverse Primer | 1 μM | 2 μl |
| Probe | 250 nM | 0.5 μl |
| DNA template | ~100 ng | 5 μl |
| Nuclease-Free water | | Bring to 20 μl |

TABLE 8 qPCR Cycling Conditions

| Step | Cycles | Temperature | Cycles |
|---|---|---|---|
| Polymerase activation | 1 | 95° C. | 3 min |
| Amplification: | 45 | | |
| Denaturation | | 95° C. | 15 sec |
| Annealing/extension | | 60° C. | 1 min |
| Hold | 1 | 4° C. | Up to 24 hr |

TABLE 9

Killing Activities

The killing activities of T-cells each identified by the Composition, SEQ ID No., and/or Clone Number prepared by using the relevant methods disclosed herein are assessed by using the relevant assays and are summarized herein. Certain entries in the following table are included for the purpose of comparison.

| Project | Composition | SEQ ID NO: | Clone Number | Killing Activity |
|---|---|---|---|---|
| GBM Dual-Tandem CAR_BiTE Targets: IL13Rα2, HER2, EGFR & EGFRvIII | Single CAR | 47 | 1_SR1 | 2 |
| | | 48 | 2_SR2 | 1 |
| | | 49 | 3_SR3 | 2 |
| | | 50 | 4_SR4 | 2 |
| | | 51 | 5_SR5 | 2 |
| | Dual-Tandem CAR | 52 | 6_SR6 | 3 |
| | | 11 | 7_SR7 | 3 |
| | | 12 | 8_SR8 | 3.5 |
| | | 13 | 9_SR9 | 4 |
| | 1-Arm BiTE | 21, 109 | 10_SR10 | 3 |
| | | 22, 110 | 11_SR11 | 3 |
| | | 23, 111 | 12_SR12 | 3 |
| | | 301 | 13_SR13 | 3 |
| | | 302 | 14_SR14 | 0 |
| | 2-Domain/Arm BiTE | 24, 176 | 15_SR15 | 3 |
| | | 25, 177 | 16_SR16 | 3 |
| | | 26, 178 | 17_SR17 | 4 |
| | | 27, 292 | 18_SR18 | 4 |
| | Dual-Tandem CAR_two-arm BiTE | 31, 293 | 20_SR20 | 5 |
| | | 32, 294 | 21_SR21 | 5 |
| | | 33, 295 | 22_SR22 | 7 |
| | | 34, 296 | 23_SR23 | 3 |
| | | 35, 297 | 24_SR24 | 6 |
| | | 36, 298 | 25_SR25 | 6 |
| | | 37, 299 | 26_SR26 | 10 |
| | | 38, 300 | 27_SR27 | 4 |
| GBM 2nd Generation Dual-Tandem CAR_BiTE | HER2 Vhh Single-domain CAR | 53 | 1_SR72 | 3.5 |
| | | 54 | 2_SR73 | 0 |
| | | 55 | 3_SR74 | 1 |
| | | 56 | 4_SR75 | 1 |
| | | 57 | 5_SR76 | 0 |
| | | 58 | 6_SR77 | 0 |
| | | 59 | 7_SR78 | 3.5 |
| | | 60 | 8_SR79 | 3 |

TABLE 9-continued

Killing Activities

The killing activities of T-cells each identified by the Composition, SEQ ID No., and/or Clone Number prepared by using the relevant methods disclosed herein are assessed by using the relevant assays and are summarized herein. Certain entries in the following table are included for the purpose of comparison.

| Project | Composition | SEQ ID NO: | Clone Number | Killing Activity |
|---|---|---|---|---|
| Targets: IL13Rα2, HER2, EGFR & EGFRVIII | | 61 | 9_SR80 | 3.5 |
| | | 62 | 10_SR81 | 0 |
| | | 63 | 11_SR82 | 4 |
| | | 64 | 12_SR83 | 0 |
| | | 65 | 13_SR84 | 0 |
| | | 66 | 14_SR85 | 0 |
| | | 67 | 15_SR86 | 0 |
| | | 68 | 16_SR87 | 2 |
| | | 69 | 17_SR88 | 0 |
| | | 70 | 18_SR89 | 0 |
| | HER2 scFv_4D5-#8_Trastuzumab CAR | 71 | 19_SR115 | 1.5 |
| | HER2 Vhh Dual-Tandem CAR | 72 | 20_SR140 | 3 |
| | | 73 | 21_SR141 | 2.5 |
| | | 74 | 22_SR142 | 3.5 |
| | | 75 | 23_SR143 | 3 |
| | | 76 | 24_SR144 | 2.5 |
| | | 77 | 25_SR145 | 2.5 |
| | | 78 | 26_SR146 | 2 |
| | | 79 | 27_SR147 | 6 |
| | | 80 | 28_SR148 | 3 |
| | | 81 | 29_SR149 | 2.5 |
| | | 82 | 30_SR150 | 3 |
| | EGFR Vhh_1-arm BiTE | 83 | 31_SR28 | 0 |
| | | 84 | 32_SR29 | 0 |
| | | 85 | 33_SR31 | 0 |
| | | 86 | 34_SR32 | 0 |
| | | 87 | 35_SR33 | 0 |
| | | 88 | 36_SR34 | 2 |
| | | 89 | 37_SR38 | 0 |
| | | 90 | 38_SR42 | 0 |
| | | 91 | 39_SR47 | 0 |
| | | 92 | 40_SR48 | 0 |
| | | 93 | 41_SR52 | 0 |
| | | 94 | 42_SR53 | 1 |
| | | 95 | 43_SR55 | 0 |
| | | 96 | 44_SR56 | 4 |
| | | 97 | 45_SR57 | 0 |
| | | 98 | 46_SR59 | 4 |
| | | 99 | 47_SR60 | 0 |
| | | 100 | 48_SR61 | 0 |
| | | 101 | 49_SR63 | 0 |
| | | 102 | 50_SR64 | 0 |
| | | 103 | 51_SR67 | 0 |
| | | 104 | 52_SR68 | 1 |
| | IL13 mutein_CAR | 105 | 53_SR120 | 2.5 |
| | IL13 mutein_CAR-EGFR_two-arm BiTE | 106 | 54_SR116 | 5 |
| | | 107 | 55_SR121 | 6 |
| | | 108 | 56_SR122 | 5.5 |
| | IL13 mutein-HER2 Vhh_Tandem CAR-EGFR_two-arm BiTE | 112 | 60_SR157 | 8.5 |
| | | 113 | 61_SR158 | 9 |
| | | 114 | 62_SR159 | 4 |
| | | 115 | 63_SR160 | 4 |
| | | 116 | 64_SR161 | 10 |
| | | 117 | 65_SR162 | 10 |
| | | 118 | 66_SR163 | 6 |
| | | 119 | 67_SR164 | 6 |
| HER2+ BC_BM Dual-Tandem CAR_BiTE Targets: HER2, EGFR & EGFRVIII | HER2 Vhh Single-domain CAR | 120 | 1_SR72 | 3.5 |
| | | 121 | 2_SR73 | 0 |
| | | 122 | 3_SR74 | 1 |
| | | 123 | 4_SR75 | 1 |
| | | 124 | 5_SR76 | 0 |
| | | 125 | 6_SR77 | 0 |
| | | 126 | 7_SR78 | 3.5 |
| | | 127 | 8_SR79 | 3 |
| | | 128 | 9_SR80 | 3.5 |
| | | 130 | 11_SR82 | 4 |
| | | 131 | 12_SR83 | 0 |
| | | 132 | 13_SR84 | 0 |
| | | 133 | 14_SR85 | 0 |
| | | 134 | 15_SR86 | 0 |

TABLE 9-continued

Killing Activities

The killing activities of T-cells each identified by the Composition, SEQ ID No., and/or Clone Number prepared by using the relevant methods disclosed herein are assessed by using the relevant assays and are summarized herein. Certain entries in the following table are included for the purpose of comparison.

| Project | Composition | SEQ ID NO: | Clone Number | Killing Activity |
|---|---|---|---|---|
| | | 135 | 16_SR87 | 2 |
| | | 136 | 17_SR88 | 0 |
| | | 137 | 18_SR89 | 0 |
| | HER2 scFv_4D5-#8_Trastuzumab CAR | 138 | 19_SR115 | 1.5 |
| | HER2 Vhh Dual-Tandem CAR | 139 | 20_SR140 | 3 |
| | | 140 | 21_SR141 | 2.5 |
| | | 141 | 22_SR142 | 3.5 |
| | | 142 | 23_SR143 | 3 |
| | | 143 | 24_SR144 | 2.5 |
| | | 144 | 25_SR145 | 2.5 |
| | | 145 | 26_SR146 | 2 |
| | | 146 | 27_SR147 | 6 |
| | | 147 | 28_SR148 | 3 |
| | | 148 | 29_SR149 | 2.5 |
| | | 149 | 30_SR150 | 3 |
| | EGFR Vhh_1-arm BiTE | 150 | 31_SR28 | 0 |
| | | 151 | 32_SR29 | 0 |
| | | 152 | 33_SR31 | 0 |
| | | 153 | 34_SR32 | 0 |
| | | 154 | 35_SR33 | 0 |
| | | 155 | 36_SR34 | 2 |
| | | 156 | 37_SR38 | 0 |
| | | 157 | 38_SR42 | 0 |
| | | 158 | 39_SR47 | 0 |
| | | 159 | 40_SR48 | 0 |
| | | 160 | 41_SR52 | 0 |
| | | 161 | 42_SR53 | 1 |
| | | 162 | 43_SR55 | 0 |
| | | 163 | 44_SR56 | 4 |
| | | 164 | 45_SR57 | 0 |
| | | 165 | 46_SR59 | 4 |
| | | 166 | 47_SR60 | 0 |
| | | 167 | 48_SR61 | 0 |
| | | 168 | 49_SR63 | 0 |
| | | 169 | 50_SR64 | 0 |
| | | 170 | 51_SR67 | 0 |
| | | 171 | 52_SR68 | 1 |
| | IL13 mutein_CAR | 172 | 53_SR120 | 2.5 |
| | IL13 mutein CAR-EGFR two-arm BiTE | 173 | 54_SR116 | 5 |
| | | 174 | 55_SR121 | 6 |
| | | 175 | 56_SR122 | 5.5 |
| | HER2 Vhh_Tandem CAR-EGFR_two-arm BiTE | 179 | 60_SR165 | 8 |
| | | 180 | 61_SR166 | 8 |
| | | 181 | 62_SR82 | 4 |
| | | 182 | 63_SR167 | 4 |
| | | 183 | 64_SR168 | 10 |
| | | 184 | 65_SR169 | 10 |
| | | 185 | 66_SR147 | 6 |
| | | 186 | 67_SR170 | 6 |
| | EGFR_scFv_Cetuximab_CAR | 187 | 1_SR126 | 2.5 |
| | EFGR_Vhh_single domain_CAR | 188 | 2_SR117 | 3.5 |
| | | 189 | 3_SR118 | 4 |
| | | 190 | 4_SR127 | 3 |
| | | 191 | 5_SR128 | 3 |
| LC_BM & TN_BC_BM Tandem CAR_BiTE Targets: EGFR & EGFRVIII | EGFR_Vhh_Tandem CAR_EGFR_two-arm BiTE | 192 | 6_SR119 | 4.5 |
| | | 193 | 7_SR129 | 10 |
| | | 194 | 8_SR130 | 4 |
| | | 195 | 9_SR131 | 7 |
| | | 196 | 10_SR132 | 3 |
| | | 197 | 11_SR133 | 4 |
| | | 198 | 12_SR134 | 3 |
| | | 199 | 13_SR135 | 4 |
| | | 200 | 14_SR136 | 3 |
| | | 201 | 15_SR137 | 4 |
| | | 202 | 16_SR138 | 2 |
| | | 203 | 17_SR139 | 3 |

TABLE 9-continued

Killing Activities

The killing activities of T-cells each identified by the Composition, SEQ ID No., and/or Clone Number prepared by using the relevant methods disclosed herein are assessed by using the relevant assays and are summarized herein. Certain entries in the following table are included for the purpose of comparison.

| Project | Composition | SEQ ID NO: | Clone Number | Killing Activity |
|---|---|---|---|---|
| Project 5 HCC Tandem CAR_BiTE Targets: GPC-3 | GPC3_Vhh_sigle domain CAR | 204 | 1_SRHCC1 | 1.5 |
| | | 205 | 2_SRHCC2 | 3.5 |
| | | 206 | 3_SRHCC3 | 3.5 |
| | | 207 | 4_SRHCC4 | 0 |
| | | 208 | 5_SRHCC5 | 3 |
| | | 209 | 6_SRHCC6 | 0 |
| | | 210 | 7_SRHCC7 | 0 |
| | | 211 | 8_SRHCC8 | 3 |
| | | 212 | 9_SRHCC9 | 0 |
| | | 213 | 10_SRHCC10 | 0 |
| | | 214 | 11_SRHCC11 | 2 |
| | GPC3_Vhh_Tandem CAR | 215 | 12_SRHCC12 | 1.5 |
| | | 216 | 13_SRHCC13 | 3.5 |
| | | 217 | 14_SRHCC14 | 2 |
| | | 218 | 15_SRHC-10 | 2.5 |
| | | 219 | 16_SRHC-2 | 4 |
| | | 220 | 17_SRHC-6 | 2 |
| | | 221 | 18_SRHC-13 | 3 |
| | GPC3_Vhh_Tandem CAR_GPC3_two-arm BiTE | 222 | 19_SRHC-2 | 4 |
| | | 223 | 20_SRHC-5 | 6 |
| | | 224 | 21_SRHC-6 | 2 |
| | | 225 | 22-SRHC-7 | 4.5 |
| | | 226 | 23-SRHC-8 | 10 |
| | | 227 | 24 SRHC-9 | 4 |
| | | 228 | 25-SRHC-10 | 2.5 |
| | | 229 | 26-SRHC-11 | 2 |
| | | 230 | 27-SRHC-12 | 4 |
| | | 231 | 28-SRHC-13 | 2 |
| | | 232 | 29-SRHC-14 | 3 |
| | | 233 | 30-SRHC-15 | 4.5 |
| | | 234 | 31-SRHC-16 | 3.5 |
| | | 235 | 32-SRHC-17 | 9 |
| | | 236 | 33-SRHC-18 | 5 |
| | | 237 | 34-SRHC-19 | 10 |
| | | 238 | 35-SRHC-4 | 3 |
| | | 239 | 36-SRHC-20 | 9 |
| | | 240 | 37-SRHC-2 | 4 |
| | | 241 | 38-SRHC-21 | 9 |

Killing Activity Scale: 0 (lowest)-10 (highest)

SEQUENCE LISTING (326 sequences)

SEQ ID NO: 1 - protein, 114 aa, Artificial Sequence
  IL13 mutein
SPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFN

SEQ ID NO: 2 - protein, 242 aa, Artificial Sequence
  HER2 scFv (4D5)
DIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSS

SEQ ID NO: 3 - protein, 242 aa, Artificial Sequence
  HER2 scFv (4D5)
DIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 4 - protein, 242 aa, Artificial Sequence
  HER2 scFv (4D5
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 5 - protein, 15 aa, Artificial Sequence
  linker
GGGGSGGGGSGGGGS

SEQ ID NO: 6 - protein, 21 aa, Artificial Sequence
  CD8a signal peptide
MALPVTALLLPLALLLHAARP

SEQ ID NO: 7 - protein, 45 aa, Artificial Sequence
  CD8a hinge/spacer
TTTPAPRPPTPAPTIASQPLSLRPEACRPAAGGAVHTRGLDFACD

SEQ ID NO: 8 - protein, 27 aa, Artificial Sequence
  CD28 transmembrane domain
FWVLVVVGGVLACYSLLVTVAFIIFWV

SEQ ID NO: 9 - protein, 42 aa, Artificial Sequence
  4-1BB
KRGRKKLLYIFKQPFMRPVQTTQEEDGCSCRFPEEEEGGCEL

SEQ ID NO: 10 - protein, 112 aa, Artificial Sequence
  CD3-zeta
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11 - protein, 618 aa, Artificial Sequence
  SR7
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 12 - protein, 618 aa, Artificial Sequence
  SR8
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 13 - protein, 618 aa, Artificial Sequence
  SR9
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 14 - protein, 243 aa, Artificial Sequence
  scFv CD3e
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 15 - protein, 124 aa, Artificial Sequence
  Vhh 7D12
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 16 - protein, 127 aa, Artificial Sequence
  Vhh 9G8
EVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSS

SEQ ID NO: 17 - protein, 129 aa, Artificial Sequence
  Vhh 38G7
EVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 18 - protein, 5 aa, Artificial Sequence
  linker
GGGGS

SEQ ID NO: 19 - protein, 21 aa, Artificial Sequence
  signal peptide
METDTLLLWVLLLWVPGSTGD

SEQ ID NO: 20 - protein, 6 aa, Artificial Sequence
  6xHis
HHHHHH

SEQ ID NO: 21 - protein, 399 aa, Artificial Sequence
  SR10
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 22 - protein, 402 aa, Artificial Sequence
  SR11
METDTLLLWVLLLWVPGSTGDEVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 23 - protein, 404 aa, Artificial Sequence
  SR12
METDTLLLWVLLLWVPGSTGDEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 24 - protein, 541 aa, Artificial Sequence
  SR15
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSEVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 25 - protein, 543 aa, Artificial Sequence
  SR16
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 26 - protein, 531 aa, Artificial Sequence
  SR17
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSSHHHHHH

SEQ ID NO: 27 - protein, 533 aa, Artificial Sequence
  SR18
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSHHHHHH

SEQ ID NO: 28 - protein, 21 aa, Artificial Sequence
  Self-cleaving T2A Peptide
GSGEGRGSLLTCGDVEENPGP

SEQ ID NO: 29 - protein, 241 aa, Artificial Sequence
  Cetuximab
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 30 - protein, 250 aa, Artificial Sequence
  Blinatumomab
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 31 - protein, 1155 aa, Artificial Sequence
  SR20
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 32 - protein, 1038 aa, Artificial Sequence
  SR21
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 33 - protein, 1172 aa, Artificial Sequence
  SR22
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSHHHHHH

SEQ ID NO: 34 - protein, 1164 aa, Artificial Sequence
  SR23
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 35 - protein, 1155 aa, Artificial Sequence
  SR24
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 36 - protein, 1038 aa, Artificial Sequence
  SR25
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 37 - protein, 1172 aa, Artificial Sequence
  SR26
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSHHHHHH

SEQ ID NO: 38 - protein, 1164 aa, Artificial Sequence
  SR27
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 39 - DNA, 212 bp, Artificial Sequence
  EF1a Core Promoter sequence
gggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacag

SEQ ID NO: 40 - DNA, 535 bp, Artificial Sequence
  MNDU3 Promoter sequence
tcgattagtccaatttgttaaagacaggatatcagtggtccaggctctagttttgactcaacaatatcaccagctgaagcctatagagtacgagccatagatagaataaaagattttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgatc

SEQ ID NO: 41 - DNA, 19 bp, Artificial Sequence
  HC HER2 ScFv-HD2 FWD
agcaagaacaccgcctatc

SEQ ID NO: 42 - DNA, 21 bp, Artificial Sequence
  HC HER2 ScFv-HD2 REV
ccaatagtccatggcgtagaa

SEQ ID NO: 43 - DNA, 25 bp, Artificial Sequence
  HC HER2 ScFv-HD2 PRB
  FAM (1)..(1): reporter molecule 6- carboxyfluorescein
  ZEN (9)..(10): ZEN Internal Quencher positioned between the ninth (9th) and tenth (10th) nucleotide base in the oligonucleotide sequence
  3IABkFQ (25)..(25): Iowa Black FQ (3IABkFQ) located at the 3'-end
agagccgaagatacagccgtctact

SEQ ID NO: 44 - DNA, 19 bp, Artificial Sequence
  7D12 VHH-HD3 FWD
gcaaggagagggagtttgt

SEQ ID NO: 45 - DNA, 20 bp, Artificial Sequence
  7D12 VHH-HD3 REV
gtcttcgggcttcagagaat

SEQ ID NO: 46 - DNA, 24 bp, Artificial Sequence
  7D12 VHH-HD3 PRB
  FAM (1)..(1): reporter molecule 6- carboxyfluorescein
  ZEN (9)..(10): ZEN Internal Quencher positioned between the ninth (9th) and tenth (10th) nucleotide base in the oligonucleotide sequence
  3IABkFQ (24)..(24): Iowa Black FQ (3IABkFQ) located at the 3'-end
aaaccttcccttcacggagtcagc

SEQ ID NO: 47 - protein, 361 aa, Artificial Sequence
  SR1
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 48 - protein, 490 aa, Artificial Sequence
  SR2
MALPVTALLLPLALLLHAARPLASQVQLQQSGPELKKPGETVKISCKASGYPFTNYGMNWVKQAPGQGLKWMGWINTSTGESTFADDFKGRFDFSLETSANTAYLQINNLKSEDMATYFCARWEVYHGYVPYWGQGTTVTVSSGGGGSGGGGSGGGGSDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEITTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 49 - protein, 489 aa, Artificial Sequence
  SR3
MALPVTALLLPLALLLHAARPDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 50 - protein, 489 aa, Artificial Sequence
  SR4
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 51 - protein, 489 aa, Artificial Sequence
  SR5
MALPVTALLLPLALLLHAARPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 52 - protein, 619 aa, Artificial Sequence
  SR6
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSLASQVQLQQSGPELKKPGETVKISCKASGYPFTNYGMNWVKQAPGQGLKWMGWINTSTGESTFADDFKGRFDFSLETSANTAYLQINNLKSEDMATYFCARWEVYHGYVPYWGQGTTVTVSSGGGGSGGGGSGGGGSDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEITTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 53 - protein, 370 aa, Artificial Sequence
  SR72
MALPVTALLLPLALLLHAARPQLQLVESGGGLVQPGGSLRLSCAASGFIFSDTAMNWVRQAPGKGLEWVSSINWSGTHTSYADSVKGRFKISRDNAKKALYLQMNSLQPEDTAVYACARGWVDSTRTVVAPLTKGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 54 - protein, 369 aa, Artificial Sequence
  SR73
MALPVTALLLPLALLLHAARPEVQLVESGGGLAQPGGSLRLSCAASGFRFTSYWMHWVRQAPGKGLEWVSAINTGGGSTYYADSVKGRFTISRDNAKNTLYLQMNSLKPEDTALYYCARDLSGSDYVVGITSWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 55 - protein, 365 aa, Artificial Sequence
  SR74
MALPVTALLLPLALLLHAARPEVQLVESGGTRVQPGGSLKLSCATSGIMFSYNTMAWYRQAPGKQRELVATITRDGSTNYADSMKGRFTISRDNAKNTLYLQMNGLKPEDTAVYYCNLGTTDWRRYNYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 56 - protein, 360 aa, Artificial Sequence
  SR75
MALPVTALLLPLALLLHAARPQLQLVESGGGLVQAGGSLRLSCVASGTFFSTKTMAWYRQAPGNQREWIATISPDGTTRHADSMKGRSTISRDNAKKVVYLQLDSLKPEDTAAYYCRDISRDLWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 57 - protein, 363 aa, Artificial Sequence
  SR76
MALPVTALLLPLALLLHAARPEVQVVESGGELVQPGGSLRLSCAASGFSISTYTMTWVRQGPGKGLEWVSTISPLRWGQSTTSYADSVKGRFTISRDNAKNTLYLQMNSLNPDDTGVYYCSRPDGKRGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 58 - protein, 360 aa, Artificial Sequence
  SR77
MALPVTALLLPLALLLHAARPEVQLVESGGGLVQAGGSLTLSCVASETIFRRNAMAWYRQAPGQQRELVASIRRGAFTYYPNSMKGRFTISRDDAKNTVFLQMNSLKPEDTGVYYCRSLNDDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 59 - protein, 362 aa, Artificial Sequence
  SR78
MALPVTALLLPLALLLHAARPEVQLVESGGGLVQPGGSLRLSCAASGFTFSSYPMAWVRQAPGKGEEWVSWISNSGGRTTYADSVKGRFTISRDNAKRTVYLQMNKLQPEDTAVYSCTRASGNGERGRGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 60 - protein, 367 aa, Artificial Sequence
  SR79
MALPVTALLLPLALLLHAARPQVQLVESGGGLVRPGGSLRLSCVLSGRTFSDYAMRWFRQAPGKEREFVASINWSGTHTDYADSVKGRFTISRDNAKKTVYLQMHSLTPTDTAVYYCTFGWGPQLPGTDYWGQGTQVTVAPTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 61 - protein, 375 aa, Artificial Sequence
  SR80
MALPVTALLLPLALLLHAARPQLQLVESGGGLVQSGGSLRLSCAASGFSLDYHAIGWFRQAPGKEREGVSCISSSGGRTNYADSVKGRFTISRDNAKNTVYLQMNSLKPEDAAVYSCAAVIYNSAWICNLLTGYEYEYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 62 - protein, 374 aa, Artificial Sequence
  SR81
MALPVTALLLPLALLLHAARPQLQLVESGGGLVQPGGSLRLSCAASGFTLDYHAIGWFRQAPGKEREGVSCISSSGGRINYADSVKGRFTISRDMTKNTVYLELNSLKPEDTAIYYCAAEIFDSSWYCPLSRNNMNYWGKGTLVAVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 63 - protein, 368 aa, Artificial Sequence
  SR82
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 64 - protein, 373 aa, Artificial Sequence
  SR83
MALPVTALLLPLALLLHAARPEVQLVESGGGMVQPGGSLRLSCAASGFTLDYYAIGWFRQAPGKEREGVSCISSSGGRTNYADSVKGRFTISRDDARNTVYLQMNTLKPEDTAVYYCAAVILDNSWHCGYSYDMDYWGKGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 65 - protein, 375 aa, Artificial Sequence
  SR84
MALPVTALLLPLALLLHAARPQLQLVESGGGLVHTGGSLRLSCAASGSTLDYHAIGWFRQAPGKEREGVSCITSSGGRTNYADSVKGRFTVSRDDAKNTVYLQMNSLKPEDTAVYYCAAVIYDSAWICNLLAGYEYRYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 66 - protein, 374 aa, Artificial Sequence
  SR85
MALPVTALLLPLALLLHAARPQLQLVESGGGLVQPGGSLTLSCAASGFPASHYYAIRWFRQAPGKERDGIACISSYDGSTNYADSVKGRFTISNDGAKKTVYLHMSDVQPEDAAVYFCAATIHFSAYEECQAYEYHYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 67 - protein, 372 aa, Artificial Sequence
  SR86
MALPVTALLLPLALLLHAARPQLQLVESGGGLVQPGGSLRLSCSASGRTFNNYVMAWFRQAAGKEREFVANINTSGGRTTYTDSVKDRFTISRDNAKNTMYIQMNNLKAEDTAVYYCAARILYNSDNSDYRKYYYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 68 - protein, 369 aa, Artificial Sequence
  SR87
MALPVTALLLPLALLLHAARPEVQVVESGGGLVQPGGSLRLSCTASGHTLDYYAIGWFRQAPGKEREGVSCITSTGTITNYADSVKGRFTISRDNAKNTVYLQMNSLKPEDTAVYYCAVLRGSYCRSNTFDAWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 69 - protein, 374 aa, Artificial Sequence
  SR88
MALPVTALLLPLALLLHAARPEVQVVESGGGLVQPGGSLRLSCAASGFTLDYHAIGWFRQAPGKEREGVSCISSSGGRTNYADSVKGRFTISRDNAKNTVYLQMNSLKPEDTAVYYCAAEIFDSAWYCPLSRYDMDYWGKGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 70 - protein, 373 aa, Artificial Sequence
  SR89
MALPVTALLLPLALLLHAARPQLQLVESGGGWVQAGGSLRLSCAASGFTLDYYAIGWFRQAPGKEREGVSCISSSGGRSNYADSVKGRFTISRDNAKNTVYLQMNSLKIEDTGVYYCAAVILDDSWQCGYYYNMDYWGKGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 71 - protein, 489 aa, Artificial Sequence; identical to SEQ ID NO: 51
  SR115

SEQ ID NO: 72 - protein, 500 aa, Artificial Sequence
  SR140
MALPVTALLLPLALLLHAARPQLQLVESGGGLVQPGGSLRLSCAASGFIFSDTAMNWVRQAPGKGLEWVSSINWSGTHTSYADSVKGRFKISRDNAKKALYLQMNSLQPEDTAVYACARGWVDSTRTVVAPLTKGQGTQVTVSSGGGGSGGGGSGGGGSEVQLVESGGGLVQPGGSLRLSCAASGFTFSSYPMAWVRQAPGKGEEWVSWISNSGGRTTYADSVKGRFTISRDNAKRTVYLQMNKLQPEDTAVYSCTRASGNGERGRGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 73 - protein, 505 aa, Artificial Sequence
  SR141
MALPVTALLLPLALLLHAARPQLQLVESGGGLVQPGGSLRLSCAASGFIFSDTAMNWVRQAPGKGLEWVSSINWSGTHTSYADSVKGRFKISRDNAKKALYLQMNSLQPEDTAVYACARGWVDSTRTVVAPLTKGQGTQVTVSSGGGGSGGGGSGGGGSQVQLVESGGGLVRPGGSLRLSCVLSGRTFSDYAMRWFRQAPGKEREFVASINWSGTHTDYADSVKGRFTISRDNAKKTVYLQMHSLTPTDTAVYYCTFGWGPQLPGTDYWGQGTQVTVAPTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 74 - protein, 506 aa, Artificial Sequence
  SR142
MALPVTALLLPLALLLHAARPQLQLVESGGGLVQPGGSLRLSCAASGFIFSDTAMNWVRQAPGKGLEWVSSINWSGTHTSYADSVKGRFKISRDNAKKALYLQMNSLQPEDTAVYACARGWVDSTRTVVAPLTKGQGTQVTVSSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 75 - protein, 497 aa, Artificial Sequence
  SR143
MALPVTALLLPLALLLHAARPEVQLVESGGGLVQPGGSLRLSCAASGFTFSSYPMAWVRQAPGKGEEWVSWISNSGGRTTYADSVKGRFTISRDNAKRTVYLQMNKLQPEDTAVYSCTRASGNGERGRGTQVTVSSGGGGSGGGGSGGGGSQVQLVESGGGLVRPGGSLRLSCVLSGRTFSDYAMRWFRQAPGKEREFVASINWSGTHTDYADSVKGRFTISRDNAKKTVYLQMHSLTPTDTAVYYCTFGWGPQLPGTDYWGQGTQVTVAPTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 76 - protein, 498 aa, Artificial Sequence
  SR144
MALPVTALLLPLALLLHAARPEVQLVESGGGLVQPGGSLRLSCAASGFTFSSYPMAWVRQAPGKGEEWVSWISNSGGRTTYADSVKGRFTISRDNAKRTVYLQMNKLQPEDTAVYSCTRASGNGERGRGTQVTVSSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 77 - protein, 503 aa, Artificial Sequence
  SR145
MALPVTALLLPLALLLHAARPQVQLVESGGGLVRPGGSLRLSCVLSGRTFSDYAMRWFRQAPGKEREFVASINWSGTHTDYADSVKGRFTISRDNAKKTVYLQMHSLTPTDTAVYYCTFGWGPQLPGTDYWGQGTQVTVAPGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 78 - protein, 504 aa, Artificial Sequence
  SR146
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 79 - protein, 509 aa, Artificial Sequence
  SR147
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 80 - protein, 514 aa, Artificial Sequence
  SR148
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 81 - protein, 511 aa, Artificial Sequence
  SR149
MALPVTALLLPLALLLHAARPQLQLVESGGGLVQPGGSLRLSCAASGFIFSDTAMNWVRQAPGKGLEWVSSINWSGTHTSYADSVKGRFKISRDNAKKALYLQMNSLQPEDTAVYACARGWVDSTRTVVAPLTKGQGTQVTVSSGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 82 - protein, 516 aa, Artificial Sequence
  SR150
MALPVTALLLPLALLLHAARPQLQLVESGGGLVQPGGSLRLSCAASGFIFSDTAMNWVRQAPGKGLEWVSSINWSGTHTSYADSVKGRFKISRDNAKKALYLQMNSLQPEDTAVYACARGWVDSTRTVVAPLTKGQGTQVTVSSGGGGSGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 83 - protein, 389 aa, Artificial Sequence
  SR28
METDTLLLWVLLLWVPGSTGDEVQVVESGGGLVQAGGSLRLSCAASGSTFSSYAMTWYRQAPGKQRELVAAISSGGSTNYAASVKGRFTISRDNAKNTLYLQMNTLKPEDTAVYYCNTDWGNGFSAEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 84 - protein, 383 aa, Artificial Sequence
  SR29
METDTLLLWVLLLWVPGSTGDQLQLVESGGGLVQAGGSLRLSCAVSISTFTTNGWDWYRQAPGKQRELVALISNDGTTTYTDSVKGRFTISRDGAKNTVYLQMNNLKPEDTAVYYCNTIPPAGSWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 85 - protein, 384 aa, Artificial Sequence
  SR31
METDTLLLWVLLLWVPGSTGDEVQLVESGGGLVQAGGSLRLSCVVSGSTFSSYAMGWYRQAPGKQRELVAAISSGVSANVADSLKGRFAISRDNAKNAVYLQMNSLKPEDTAVYYCNTLPRSMPYWGKGTLVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 86 - protein, 387 aa, Artificial Sequence
  SR32
METDTLLLWVLLLWVPGSTGDEVQLVESGGGLVQAGGSLRLSCAASGSTLSSYAMGWYRQAPGKQRELVAAISSGGGSTNYRDSVKGRFTISRDNAKNTVYLQMNSLKPEDTAVYYCKSTDYGSLFDSWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 87 - protein, 383 aa, Artificial Sequence
  SR33
METDTLLLWVLLLWVPGSTGDQVQLVESGGGLVQAGGSLRLSCAAFISTFGRTDMTWYRQRSGNEREFVARISSGGSTIYADSAKGRFTISRDNVKNTVYLQMNSLTPEDTAVYYCNTVPPRGSWSQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 88 - protein, 386 aa, Artificial Sequence
  SR34
METDTLLLWVLLLWVPGSTGDEVQVVESGGGLVQPGGSLRLSCAASDDISSIYTMAWYRQAPGKQRELVALVTPGGGTNYADSVKGRFTISRDNAKNTVYLQMNSLKPEDTAVYYCNARHRVTGFAYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 89 - protein, 383 aa, Artificial Sequence
  SR38
METDTLLLWVLLLWVPGSTGDEVQLVESGGGLVQPGGSLRLSCAVSQSISSINAMDWYRQAPGKQRELVAIIFNNGRTNYADSVKGRFTISRDNARNTVYLQMNSLKPEDTAVYYCNIVPPLRNWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 90 - protein, 385 aa, Artificial Sequence
  SR42
METDTLLLWVLLLWVPGSTGDEVQLVESGGGLVRAGGSLRLSCAASGTISSYDVVGWYRQAPGKQRELVALIGTDRWLNLGDFAKGRFTMSTDDAANTVDLEMNSLKPEDTAVYYCYTFQHTVGPRWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 91 - protein, 383 aa, Artificial Sequence
  SR47
METDTLLLWVLLLWVPGSTGDQLQLVESGGGLVQAGGSLKLSCVASGFTFSNYAMAWYRQAPGKQRELIASCSASCIWTNYGASVKGRFTMSLDNAKKTVYLQMDSLKPEDTAVYYCRNLDANYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 92 - protein, 383 aa, Artificial Sequence
  SR48
METDTLLLWVLLLWVPGSTGDEVQLVESGGGLVQAGGSLRLSCAASGFRIINDRMAWYRQAPGKQREAVASIDYAGSTTYAEFVKGRFTISRDNTKNMVTLQMNNLEPEDTAVYYCNTAPIARFRGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 93 - protein, 382 aa, Artificial Sequence
  SR52
METDTLLLWVLLLWVPGSTGDEVQVVESGGGLVQAGGSLRLSCAASTITISSAGVSWYRQAPGKQRELVAIITRGGSTNYADSVKGRFTISRDNAKNTHYLQMYNLKPEDTGIYYCNVVPPTYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 94 - protein, 383 aa, Artificial Sequence
  SR53
METDTLLLWVLLLWVPGSTGDQVQLVESGGGLVQAGGSLRLSCAASEGTLSSEAMGWHRLAPGKQRESVGFISSGGSTNYRDSVKGRFTISRDNAKNTVYLQMNSLKPEDTGVYFCRIPNSVGPWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 95 - protein, 383 aa, Artificial Sequence
  SR55
METDTLLLWVLLLWVPGSTGDEVQVVESGGGLVQAGGSLRLSCVASGFDFSDSVMGWYRQAPGKQREAVAIISSVGQSNYRDSVQGRFTVSRSNTENTMYLQMDSLKPEDTAIYYCKKFGPGEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 96 - protein, 396 aa, Artificial Sequence
  SR56
METDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 97 - protein, 400 aa, Artificial Sequence
  SR57
METDTLLLWVLLLWVPGSTGDQVQLVESGGGLVQPGGSLRLSCAASGFSLDAYAIGWFRQAPGMGREGVSCISSAGNTDYADSVKGRFAISRDNAKNTVYLQMNSLKPEDSGVYYCARTSEGVYRGRLACALYESAADFRSGGQGTRVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 98 - protein, 391 aa, Artificial Sequence
  SR59
METDTLLLWVLLLWVPGSTGDQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 99 - protein, 383 aa, Artificial Sequence
  SR60
METDTLLLWVLLLWVPGSTGDQVQLVESGGGLVQPGGSLRLSCVVSESISVINAMTWYRQAPGKQRELVALISRGGSTNYADSVKGRFTISRDNAKNSVYLQMNSLKPEDTALYYCNVVPPLGSWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 100 - protein, 384 aa, Artificial Sequence
  SR61
METDTLLLWVLLLWVPGSTGDQLQLVESGGGLVRPGGSLRLSCAASGSIFSRSGATWYRQAPGKQRELVALLTRDGHTDYPVVSVKGRFTISKDNAKNTVYLQMNSLQPEDTAVYYCNAIPPLGSWGRGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 101 - protein, 382 aa, Artificial Sequence
  SR63
METDTLLLWVLLLWVPGSTGDEVQVVESGGGLVQPGGSLRLSCAASGSGFTINAMTWYRRAPGKERELVAIITNGGITNYADSVKGRFTISRDNAKSTVYLQMDGLEPEDTAVYYCNIVPPVYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 102 - protein, 394 aa, Artificial Sequence
  SR64
METDTLLLWVLLLWVPGSTGDQVQLVESGGGLVQAGGSLRLSCVASGRFPSIYRMAWFRQAPGKERDFVAAINWGGTATYYEDSVKGRFTISRDNTKNTVWLQMNSLKPEDTAVYYCAAGTGTTYTPQRGDAYGYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 103 - protein, 383 aa, Artificial Sequence
  SR67
METDTLLLWVLLLWVPGSTGDQLQLVESGGGLVQPGGSLRLSCAASRSISSINTMTWYRYQGPGKERELVALITLGGTTNYADSVKGRFTISRDDAKNTLYLEMNSLKPEDTAVYYCNAVPPFRWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 104 - protein, 384 aa, Artificial Sequence
  SR68
METDTLLLWVLLLWVPGSTGDEVQVVESGGGLVQPGGSLRLSCVASGIIFSSYAMGWYRQAPGKQRELVARISSGGGLYYEDPVKGRFTISRDNARNTVYLQMSSVKPEDTAVYYCNVVPYTPGYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 105 - protein, 361 aa, Artificial Sequence; identical to SEQ ID NO: 47
  SR120

SEQ ID NO: 106 - protein, 905 aa, Artificial Sequence
  SR116
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSS

SEQ ID NO: 107 - protein, 909 aa, Artificial Sequence
  SR121
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 108 - protein, 907 aa, Artificial Sequence
  SR122
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 109 - protein, 393 aa, Artificial Sequence
  SR10
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 110 - protein, 396 aa, Artificial Sequence
  SR11
METDTLLLWVLLLWVPGSTGDEVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 111 - protein, 398 aa, Artificial Sequence
  SR12
METDTLLLWVLLLWVPGSTGDEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 112 - protein, 1045 aa, Artificial Sequence
  SR157
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 113 - protein, 1043 aa, Artificial Sequence
  SR158
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 114 - protein, 497 aa, Artificial Sequence
  SR159
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 115 - protein, 1037 aa, Artificial Sequence
  SR160
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 116 - protein, 1186 aa, Artificial Sequence
  SR161
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 117 - protein, 1184 aa, Artificial Sequence
  SR162
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 118 - protein, 638 aa, Artificial Sequence
  SR163
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 119 - protein, 1178 aa, Artificial Sequence
  SR164
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 120 - protein, 370 aa, Artificial Sequence; identical to SEQ ID NO: 53
  SR72

SEQ ID NO: 121 - protein, 369 aa, Artificial Sequence; identical to SEQ ID NO: 54
  SR73

SEQ ID NO: 122 - protein, 365 aa, Artificial Sequence; identical to SEQ ID NO: 55
  SR74

SEQ ID NO: 123 - protein, 360 aa, Artificial Sequence; identical to SEQ ID NO: 56
  SR75

SEQ ID NO: 124 - protein, 363 aa, Artificial Sequence; identical to SEQ ID NO: 57
  SR76

SEQ ID NO: 125 - protein, 360 aa, Artificial Sequence; identical to SEQ ID NO: 58
  SR77

SEQ ID NO: 126 - protein, 362 aa, Artificial Sequence; identical to SEQ ID NO: 59
  SR78

SEQ ID NO: 127 - protein, 367 aa, Artificial Sequence; identical to SEQ ID NO: 60
  SR79

SEQ ID NO: 128 - protein, 375 aa, Artificial Sequence; identical to SEQ ID NO: 61
  SR80

SEQ ID NO: 129 - protein, 374 aa, Artificial Sequence; identical to SEQ ID NO: 62
  SR81

SEQ ID NO: 130 - protein, 368 aa, Artificial Sequence; identical to SEQ ID NO: 63
  SR82

SEQ ID NO: 131 - protein, 373 aa, Artificial Sequence; identical to SEQ ID NO: 64
  SR83

SEQ ID NO: 132 - protein, 375 aa, Artificial Sequence; identical to SEQ ID NO: 65
  SR84

SEQ ID NO: 133 - protein, 374 aa, Artificial Sequence; identical to SEQ ID NO: 66
  SR85

SEQ ID NO: 134 - protein, 372 aa, Artificial Sequence; identical to SEQ ID NO: 67
  SR86

SEQ ID NO: 135 - protein, 369 aa, Artificial Sequence; identical to SEQ ID NO: 68
  SR87

SEQ ID NO: 136 - protein, 374 aa, Artificial Sequence; identical to SEQ ID NO: 69
  SR88

SEQ ID NO: 137 - protein, 373 aa, Artificial Sequence; identical to SEQ ID NO: 70
  SR89

SEQ ID NO: 138 - protein, 489 aa, Artificial Sequence; identical to SEQ ID NO: 51
  SR115

SEQ ID NO: 139 - protein, 500 aa, Artificial Sequence; identical to SEQ ID NO: 72
  SR140

SEQ ID NO: 140 - protein, 505 aa, Artificial Sequence; identical to SEQ ID NO: 73
  SR141

SEQ ID NO: 141 - protein, 506 aa, Artificial Sequence; identical to SEQ ID NO: 74
  SR142

SEQ ID NO: 142 - protein, 497 aa, Artificial Sequence; identical to SEQ ID NO: 75
  SR143

SEQ ID NO: 143 - protein, 498 aa, Artificial Sequence; identical to SEQ ID NO: 76
  SR144

SEQ ID NO: 144 - protein, 503 aa, Artificial Sequence; identical to SEQ ID NO: 77
  SR145

SEQ ID NO: 145 - protein, 504 aa, Artificial Sequence; identical to SEQ ID NO: 78
  SR146

SEQ ID NO: 146 - protein, 509 aa, Artificial Sequence; identical to SEQ ID NO: 79
  SR147

SEQ ID NO: 147 - protein, 514 aa, Artificial Sequence; identical to SEQ ID NO: 80
  SR148

SEQ ID NO: 148 - protein, 511 aa, Artificial Sequence; identical to SEQ ID NO: 81
  SR149

SEQ ID NO: 149 - protein, 516 aa, Artificial Sequence; identical to SEQ ID NO: 82
  SR150

SEQ ID NO: 150 - protein, 389 aa, Artificial Sequence; identical to SEQ ID NO: 83
  SR28

SEQ ID NO: 151 - protein, 383 aa, Artificial Sequence; identical to SEQ ID NO: 84
  SR29

SEQ ID NO: 152 - protein, 384 aa, Artificial Sequence; identical to SEQ ID NO: 85
  SR31

SEQ ID NO: 153 - protein, 387 aa, Artificial Sequence; identical to SEQ ID NO: 86
  SR32

SEQ ID NO: 154 - protein, 383 aa, Artificial Sequence; identical to SEQ ID NO: 87
  SR33

SEQ ID NO: 155 - protein, 386 aa, Artificial Sequence; identical to SEQ ID NO: 88
  SR34

SEQ ID NO: 156 - protein, 383 aa, Artificial Sequence; identical to SEQ ID NO: 89
  SR38

SEQ ID NO: 157 - protein, 385 aa, Artificial Sequence; identical to SEQ ID NO: 90
  SR42

SEQ ID NO: 158 - protein, 383 aa, Artificial Sequence; identical to SEQ ID NO: 91
  SR47

SEQ ID NO: 159 - protein, 383 aa, Artificial Sequence; identical to SEQ ID NO: 92
  SR48

SEQ ID NO: 160 - protein, 382 aa, Artificial Sequence; identical to SEQ ID NO: 93
  SR52

SEQ ID NO: 161 - protein, 383 aa, Artificial Sequence; identical to SEQ ID NO: 94
  SR53

SEQ ID NO: 162 - protein, 383 aa, Artificial Sequence; identical to SEQ ID NO: 95
  SR55

SEQ ID NO: 163 - protein, 396 aa, Artificial Sequence; identical to SEQ ID NO: 96
  SR56

SEQ ID NO: 164 - protein, 400 aa, Artificial Sequence; identical to SEQ ID NO: 97
  SR57

SEQ ID NO: 165 - protein, 391 aa, Artificial Sequence; identical to SEQ ID NO: 98
  SR59

SEQ ID NO: 166 - protein, 383 aa, Artificial Sequence; identical to SEQ ID NO: 99
  SR60

SEQ ID NO: 167 - protein, 384 aa, Artificial Sequence; identical to SEQ ID NO: 100
  SR61

SEQ ID NO: 168 - protein, 382 aa, Artificial Sequence; identical to SEQ ID NO: 101
  SR63

SEQ ID NO: 169 - protein, 394 aa, Artificial Sequence; identical to SEQ ID NO: 102
  SR64

SEQ ID NO: 170 - protein, 383 aa, Artificial Sequence; identical to SEQ ID NO: 103
  SR67

SEQ ID NO: 171 - protein, 384 aa, Artificial Sequence; identical to SEQ ID NO: 104
  SR68

SEQ ID NO: 172 - protein, 361 aa, Artificial Sequence; identical to SEQ ID NO: 47
  SR120

SEQ ID NO: 173 - protein, 905 aa, Artificial Sequence; identical to SEQ ID NO: 106
  SR116

SEQ ID NO: 174 - protein, 909 aa, Artificial Sequence; identical to SEQ ID NO: 107
  SR121

SEQ ID NO: 175 - protein, 907 aa, Artificial Sequence; identical to SEQ ID NO: 108
  SR122

SEQ ID NO: 176 - protein, 535 aa, Artificial Sequence
  SR15
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSEVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 177 - protein, 537 aa, Artificial Sequence
  SR16
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 178 - protein, 525 aa, Artificial Sequence
  SR17
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSS

SEQ ID NO: 179 - protein, 916 aa, Artificial Sequence
  SR165
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 180 - protein, 914 aa, Artificial Sequence
  SR166
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 181 - protein, 368 aa, Artificial Sequence; identical to SEQ ID NO: 63
  SR82

SEQ ID NO: 182 - protein, 908 aa, Artificial Sequence
  SR167
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 183 - protein, 1057 aa, Artificial Sequence
  SR168
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 184 - protein, 1055 aa, Artificial Sequence
  SR169
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 185 - protein, 509 aa, Artificial Sequence; identical to SEQ ID NO: 79
  SR147

SEQ ID NO: 186 - protein, 1049 aa, Artificial Sequence
  SR170
MALPVTALLLPLALLLHAARPQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVGGGGSGGGGSGGGGSGGGGSQLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSVTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 187 - protein, 488 aa, Artificial Sequence
  SR126
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 188 - protein, 374 aa, Artificial Sequence
  SR117
MALPVTALLLPLALLLHAARPEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 189 - protein, 369 aa, Artificial Sequence
  SR118
MALPVTALLLPLALLLHAARPQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 190 - protein, 371 aa, Artificial Sequence
  SR127
MALPVTALLLPLALLLHAARPQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 191 - protein, 376 aa, Artificial Sequence
  SR128
MALPVTALLLPLALLLHAARPEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 192 - protein, 511 aa, Artificial Sequence
  SR119
MALPVTALLLPLALLLHAARPEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSGGGGSGGGGSQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 193 - protein, 1059 aa, Artificial Sequence
  SR129
MALPVTALLLPLALLLHAARPEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSGGGGSGGGGSQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 194 - protein, 515 aa, Artificial Sequence
  SR130
MALPVTALLLPLALLLHAARPQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 195 - protein, 1059 aa, Artificial Sequence
  SR131
MALPVTALLLPLALLLHAARPQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSS

SEQ ID NO: 196 - protein, 513 aa, Artificial Sequence
  SR132
MALPVTALLLPLALLLHAARPEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSGGGGSGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 197 - protein, 1059 aa, Artificial Sequence
  SR133
MALPVTALLLPLALLLHAARPEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSGGGGSGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 198 - protein, 518 aa, Artificial Sequence
  SR134
MALPVTALLLPLALLLHAARPEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSGGGGSGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 199 - protein, 1059 aa, Artificial Sequence
  SR135
MALPVTALLLPLALLLHAARPEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSGGGGSGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 200 - protein, 508 aa, Artificial Sequence
  SR136
MALPVTALLLPLALLLHAARPQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSGGGGSGGGGSGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 201 - protein, 1059 aa, Artificial Sequence
  SR137
MALPVTALLLPLALLLHAARPQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSGGGGSGGGGSGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 202 - protein, 513 aa, Artificial Sequence
  SR138
MALPVTALLLPLALLLHAARPQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSGGGGSGGGGSGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 203 - protein, 1059 aa, Artificial Sequence
  SR139
MALPVTALLLPLALLLHAARPQVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSSGGGGSGGGGSGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDEVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 204 - protein, 369 aa, Artificial Sequence
  SRHCC1
MALPVTALLLPLALLLHAARPQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 205 - protein, 370 aa, Artificial Sequence
  SRHCC2
MALPVTALLLPLALLLHAARPQVQLVESGGGLVQPGGSLRLSCAASGFTLDAYAIGWFRQAPGKEREGVSYITSGTGTTLYADSVKGRFTISRDNAKNTVYLQMNSLKPEDTAVYFCTTLKRTTAGGWPIPGRIGGQGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - protein, 370 aa, Artificial Sequence
  SRHCC3
MALPVTALLLPLALLLHAARPQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 207 - protein, 370 aa, Artificial Sequence
  SRHCC4
MALPVTALLLPLALLLHAARPQLQLVESGGGLVQPGGSLRLSCAASGFTLDVYAIGWFRQAPGKEREGVSYITGGTGTTVYADSVKGRFTISRDNTKNTVYLQMNSLKPEDTAVYFCATLKRTTAGGWPKPGRIGGQGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - protein, 370 aa, Artificial Sequence
  SRHCC5
MALPVTALLLPLALLLHAARPQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 209 - protein, 366 aa, Artificial Sequence
  SRHCC6
MALPVTALLLPLALLLHAARPQVQLVESGGGLVQLGGSLTLSCVASGDVHKINAKGWYRQAPGKEREVVAIITSGGTPYYADAVKGRFTISRHDDKNTVTLQMNSLKPEDTAMYYCAAGLRGMGPYDYDYRGPGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 210 - protein, 369 aa, Artificial Sequence
  SRHCC7
MALPVTALLLPLALLLHAARPQVQLVESGGGLVQAGGSLKLSCAASGRSFSPYAMGWFRQAPGKDREFVAAISNSGGSTYYADAVKGRFSISRDNAKNTVYLQMNNLEPEDTAVYYCTGPVKRYSTDFQGGDYWGQGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - protein, 368 aa, Artificial Sequence
  SRHCC8
MALPVTALLLPLALLLHAARPQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSAASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 212 - protein, 369 aa, Artificial Sequence
  SRHCC9
MALPVTALLLPLALLLHAARPQVQLVESGGGLVQAGGSLRLSCAFSGRTFSKYAMAWFRQAPGKGRDFVARVGPSGRTTDYADSVKGRFTVSRDNAKNTVSLQMSSLKPDDAALYYCAATSGIYGESYNLYNYWGQGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213 - protein, 369 aa, Artificial Sequence
  SRHCC10
MALPVTALLLPLALLLHAARPQVQLVESGGGLVRPGGSLRVSCAASGVDISTYTMAWYRQAPGEQRESVAAISTTGRSIYIDAVQGRFTMSRDNAKNTVYLQMNNLKPEDTAVYYCNSADDLKIGTQYFKGLGWGQGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 214 - protein, 369 aa, Artificial Sequence
  SRHCC11
MALPVTALLLPLALLLHAARPQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 215 - protein, 505 aa, Artificial Sequence
  SRHCC12
MALPVTALLLPLALLLHAARPQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSAGGGGSGGGGSGGGGSQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSAASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 216 - protein, 506 aa, Artificial Sequence
  SRHCC13
MALPVTALLLPLALLLHAARPQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSAGGGGSGGGGSGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - protein, 507 aa, Artificial Sequence
  SRHCC14
MALPVTALLLPLALLLHAARPQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSGGGGSGGGGSGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 218 - protein, 507 aa, Artificial Sequence
  SRHC-10
MALPVTALLLPLALLLHAARPQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSGGGGSGGGGSQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSATTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 219 - protein, 508 aa, Artificial Sequence
  SRHC-2
MALPVTALLLPLALLLHAARPQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSGGGGSGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - protein, 510 aa, Artificial Sequence
  SRHC-6
MALPVTALLLPLALLLHAARPQVQLVESGGGLVQPGGSLRLSCAASGFTLDAYAIGWFRQAPGKEREGVSYITSGTGTTLYADSVKGRFTISRDNAKNTVYLQMNSLKPEDTAVYFCTTLKRTTAGGWPIPGRIGGQGTQVTVSSGGGGSGGGGSGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 221 - protein, 509 aa, Artificial Sequence
  SRHC-13
MALPVTALLLPLALLLHAARPQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSGGGGSGGGGSGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 222 - protein, 508 aa, Artificial Sequence; identical to SEQ ID NO: 219
  SRHC-2

SEQ ID NO: 223 - protein, 1051 aa, Artificial Sequence
  SRHC-5
MALPVTALLLPLALLLHAARPQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSGGGGSGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGGLVQPGGSLRLSCAASGFTLDAYAIGWFRQAPGKEREGVSYITSGTGTTLYADSVKGRFTISRDNAKNTVYLQMNSLKPEDTAVYFCTTLKRTTAGGWPIPGRIGGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSS

SEQ ID NO: 224 - protein, 510 aa, Artificial Sequence; identical to SEQ ID NO: 220
  SRHC-6

SEQ ID NO: 225 - protein, 1051 aa, Artificial Sequence
  SRHC-7
MALPVTALLLPLALLLHAARPQVQLVESGGGLVQPGGSLRLSCAASGFTLDAYAIGWFRQAPGKEREGVSYITSGTGTTLYADSVKGRFTISRDNAKNTVYLQMNSLKPEDTAVYFCTTLKRTTAGGWPIPGRIGGQGTQVTVSSGGGGSGGGGSGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSS

SEQ ID NO: 226 - protein, 1052 aa, Artificial Sequence
  SRHC-8
MALPVTALLLPLALLLHAARPQVQLVESGGGLVQPGGSLRLSCAASGFTLDAYAIGWFRQAPGKEREGVSYITSGTGTTLYADSVKGRFTISRDNAKNTVYLQMNSLKPEDTAVYFCTTLKRTTAGGWPIPGRIGGQGTQVTVSSGGGGSGGGGSGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSS

SEQ ID NO: 227 - protein, 1050 aa, Artificial Sequence
  SRHC-9
MALPVTALLLPLALLLHAARPQVQLVESGGGLVQPGGSLRLSCAASGFTLDAYAIGWFRQAPGKEREGVSYITSGTGTTLYADSVKGRFTISRDNAKNTVYLQMNSLKPEDTAVYFCTTLKRTTAGGWPIPGRIGGQGTQVTVSSGGGGSGGGGSGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSA

SEQ ID NO: 228 - protein, 507 aa, Artificial Sequence; identical to SEQ ID NO: 218
  SRHC-10

SEQ ID NO: 229 - protein, 1050 aa, Artificial Sequence
  SRHC-11
MALPVTALLLPLALLLHAARPQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSGGGGSGGGGSQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSATTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGGLVQPGGSLRLSCAASGFTLDAYAIGWFRQAPGKEREGVSYITSGTGTTLYADSVKGRFTISRDNAKNTVYLQMNSLKPEDTAVYFCTTLKRTTAGGWPIPGRIGGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSS

SEQ ID NO: 230 - protein, 1049 aa, Artificial Sequence
  SRHC-12
MALPVTALLLPLALLLHAARPQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSGGGGSGGGGSQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSATTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSS

SEQ ID NO: 231 - protein, 509 aa, Artificial Sequence; identical to SEQ ID NO: 221
  SRHC-13

SEQ ID NO: 232 - protein, 1052 aa, Artificial Sequence
  SRHC-14
MALPVTALLLPLALLLHAARPQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSGGGGSGGGGSGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGGLVQPGGSLRLSCAASGFTLDAYAIGWFRQAPGKEREGVSYITSGTGTTLYADSVKGRFTISRDNAKNTVYLQMNSLKPEDTAVYFCTTLKRTTAGGWPIPGRIGGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSS

SEQ ID NO: 233 - protein, 1049 aa, Artificial Sequence
  SRHC-15
MALPVTALLLPLALLLHAARPQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSGGGGSGGGGSGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSA

SEQ ID NO: 234 - protein, 371 aa, Artificial Sequence
  SRHC-16
MALPVTALLLPLALLLHAARPQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 235 - protein, 913 aa, Artificial Sequence
  SRHC-17
MALPVTALLLPLALLLHAARPQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSS

SEQ ID NO: 236 - protein, 515 aa, Artificial Sequence
  SRHC-18
MALPVTALLLPLALLLHAARPQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSGGGGSGGGGSGGGGSGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - protein, 1057 aa, Artificial Sequence
  SRHC-19
MALPVTALLLPLALLLHAARPQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSGGGGSGGGGSGGGGSGGGGSQVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSS

SEQ ID NO: 238 - protein, 489 aa, Artificial Sequence
  SRHC-4
MALPVTALLLPLALLLHAARPDVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 239 - protein, 1031 aa, Artificial Sequence
  SRHC-20
MALPVTALLLPLALLLHAARPDVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSS

SEQ ID NO: 240 - protein, 508 aa, Artificial Sequence; identical to SEQ ID NO: 219
  SRHC-2

SEQ ID NO: 241 - protein, 1040 aa, Artificial Sequence
  SRHC-21
MALPVTALLLPLALLLHAARPQLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSSGGGGSGGGGSGGGGSQVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 242 - protein, 123 aa, Artificial Sequence
  SR72_Vhh
QLQLVESGGGLVQPGGSLRLSCAASGFIFSDTAMNWVRQAPGKGLEWVSSINWSGTHTSYADSVKGRFKISRDNAKKALYLQMNSLQPEDTAVYACARGWVDSTRTVVAPLTKGQGTQVTVSS

SEQ ID NO: 243 - protein, 122 aa, Artificial Sequence
  SR73_Vhh
EVQLVESGGGLAQPGGSLRLSCAASGFRFTSYWMHWVRQAPGKGLEWVSAINTGGGSTYYADSVKGRFTISRDNAKNTLYLQMNSLKPEDTALYYCARDLSGSDYVVGITSWGQGTQVTVSS

SEQ ID NO: 244 - protein, 118 aa, Artificial Sequence
  SR74_Vhh
EVQLVESGGTRVQPGGSLKLSCATSGIMFSYNTMAWYRQAPGKQRELVATITRDGSTNYADSMKGRFTISRDNAKNTLYLQMNGLKPEDTAVYYCNLGTTDWRRYNYWGQGTQVTVSS

SEQ ID NO: 245 - protein, 113 aa, Artificial Sequence
  SR75_Vhh
QLQLVESGGGLVQAGGSLRLSCVASGTFFSTKTMAWYRQAPGNQREWIATISPDGTTRHADSMKGRSTISRDNAKKVVYLQLDSLKPEDTAAYYCRDISRDLWGQGTQVTVSS

SEQ ID NO: 246 - protein, 116 aa, Artificial Sequence
  SR76_Vhh
EVQVVESGGELVQPGGSLRLSCAASGFSISTYTMTWVRQGPGKGLEWVSTISPLRWGQSTTSYADSVKGRFTISRDNAKNTLYLQMNSLNPDDTGVYYCSRPDGKRGQGTQVTVSS

SEQ ID NO: 247 - protein, 113 aa, Artificial Sequence
  SR77_Vhh
EVQLVESGGGLVQAGGSLTLSCVASETIFRRNAMAWYRQAPGQQRELVASIRRGAFTYYPNSMKGRFTISRDDAKNTVFLQMNSLKPEDTGVYYCRSLNDDYWGQGTQVTVSS

SEQ ID NO: 248 - protein, 115 aa, Artificial Sequence
  SR78_Vhh
EVQLVESGGGLVQPGGSLRLSCAASGFTFSSYPMAWVRQAPGKGEEWVSWISNSGGRTTYADSVKGRFTISRDNAKRTVYLQMNKLQPEDTAVYSCTRASGNGERGRGTQVTVSS

SEQ ID NO: 249 - protein, 120 aa, Artificial Sequence
  SR79_Vhh
QVQLVESGGGLVRPGGSLRLSCVLSGRTFSDYAMRWFRQAPGKEREFVASINWSGTHTDYADSVKGRFTISRDNAKKTVYLQMHSLTPTDTAVYYCTFGWGPQLPGTDYWGQGTQVTVAP

SEQ ID NO: 250 - protein, 128 aa, Artificial Sequence
  SR80_Vhh
QLQLVESGGGLVQSGGSLRLSCAASGFSLDYHAIGWFRQAPGKEREGVSCISSSGGRTNYADSVKGRFTISRDNAKNTVYLQMNSLKPEDAAVYSCAAVIYNSAWICNLLTGYEYEYWGQGTQVTVSS

SEQ ID NO: 251 - protein, 127 aa, Artificial Sequence
  SR81_Vhh
QLQLVESGGGLVQPGGSLRLSCAASGFTLDYHAIGWFRQAPGKEREGVSCISSSGGRINYADSVKGRFTISRDMTKNTVYLELNSLKPEDTAIYYCAAEIFDSSWYCPLSRNNMNYWGKGTLVAVSS

SEQ ID NO: 252 - protein, 121 aa, Artificial Sequence
  SR82_Vhh
QLQLVESGGDLVQPGGSLRLSCAGSGFTLDAYAIGWFRQAPGKEREGVSCISSSGGTTSYADSVKGRFTISRDYAKNTVYLQMNAVKPEDTAVYYCAIERTCERIGASQFRGQGTQVTVSV

SEQ ID NO: 253 - protein, 126 aa, Artificial Sequence
  SR83_Vhh
EVQLVESGGGMVQPGGSLRLSCAASGFTLDYYAIGWFRQAPGKEREGVSCISSSGGRTNYADSVKGRFTISRDDARNTVYLQMNTLKPEDTAVYYCAAVILDNSWHCGYSYDMDYWGKGTLVTVSS

SEQ ID NO: 254 - protein, 128 aa, Artificial Sequence
  SR84_Vhh
QLQLVESGGGLVHTGGSLRLSCAASGSTLDYHAIGWFRQAPGKEREGVSCITSSGGRTNYADSVKGRFTVSRDDAKNTVYLQMNSLKPEDTAVYYCAAVIYDSAWICNLLAGYEYRYWGQGTQVTVSS

SEQ ID NO: 255 - protein, 127 aa, Artificial Sequence
  SR85_Vhh
QLQLVESGGGLVQPGGSLTLSCAASGFPASHYYAIRWFRQAPGKERDGIACISSYDGSTNYADSVKGRFTISNDGAKKTVYLHMSDVQPEDAAVYFCAATIHFSAYEECQAYEYHYWGQGTQVTVSS

SEQ ID NO: 256 - protein, 125 aa, Artificial Sequence
  SR86_Vhh
QLQLVESGGGLVQPGGSLRLSCSASGRTFNNYVMAWFRQAAGKEREFVANINTSGGRTTYTDSVKDRFTISRDNAKNTMYIQMNNLKAEDTAVYYCAARILYNSDNSDYRKYYYWGQGTQVTVSS

SEQ ID NO: 257 - protein, 122 aa, Artificial Sequence
  SR87_Vhh
EVQVVESGGGLVQPGGSLRLSCTASGHTLDYYAIGWFRQAPGKEREGVSCITSTGTITNYADSVKGRFTISRDNAKNTVYLQMNSLKPEDTAVYYCAVLRGSYCRSNTFDAWGQGTLVTVSS

SEQ ID NO: 258 - protein, 127 aa, Artificial Sequence
  SR88_Vhh
EVQVVESGGGLVQPGGSLRLSCAASGFTLDYHAIGWFRQAPGKEREGVSCISSSGGRTNYADSVKGRFTISRDNAKNTVYLQMNSLKPEDTAVYYCAAEIFDSAWYCPLSRYDMDYWGKGTLVTVSS

SEQ ID NO: 259 - protein, 126 aa, Artificial Sequence
  SR89_Vhh
QLQLVESGGGWVQAGGSLRLSCAASGFTLDYYAIGWFRQAPGKEREGVSCISSSGGRSNYADSVKGRFTISRDNAKNTVYLQMNSLKIEDTGVYYCAAVILDDSWQCGYYYNMDYWGKGTLVTVSS

SEQ ID NO: 260 - protein, 120 aa, Artificial Sequence
  SR28_Vhh
EVQVVESGGGLVQAGGSLRLSCAASGSTFSSYAMTWYRQAPGKQRELVAAISSGGSTNYAASVKGRFTISRDNAKNTLYLQMNTLKPEDTAVYYCNTDWGNGFSAEYDYWGQGTQVTVSS

SEQ ID NO: 261 - protein, 114 aa, Artificial Sequence
  SR29_Vhh
QLQLVESGGGLVQAGGSLRLSCAVSISTFTTNGWDWYRQAPGKQRELVALISNDGTTTYTDSVKGRFTISRDGAKNTVYLQMNNLKPEDTAVYYCNTIPPAGSWGQGTQVTVSS

SEQ ID NO: 262 - protein, 115 aa, Artificial Sequence
  SR31_Vhh
EVQLVESGGGLVQAGGSLRLSCVVSGSTFSSYAMGWYRQAPGKQRELVAAISSGVSANVADSLKGRFAISRDNAKNAVYLQMNSLKPEDTAVYYCNTLPRSMPYWGKGTLVTVSS

SEQ ID NO: 263 - protein, 118 aa, Artificial Sequence
  SR32_Vhh
EVQLVESGGGLVQAGGSLRLSCAASGSTLSSYAMGWYRQAPGKQRELVAAISSGGGSTNYRDSVKGRFTISRDNAKNTVYLQMNSLKPEDTAVYYCKSTDYGSLFDSWGQGTQVTVSS

SEQ ID NO: 264 - protein, 114 aa, Artificial Sequence
  SR33_Vhh
QVQLVESGGGLVQAGGSLRLSCAAFISTFGRTDMTWYRQRSGNEREFVARISSGGSTIYADSAKGRFTISRDNVKNTVYLQMNSLTPEDTAVYYCNTVPPRGSWSQGTQVTVSS

SEQ ID NO: 265 - protein, 117 aa, Artificial Sequence
  SR34_Vhh
EVQVVESGGGLVQPGGSLRLSCAASDDISSIYTMAWYRQAPGKQRELVALVTPGGGTNYADSVKGRFTISRDNAKNTVYLQMNSLKPEDTAVYYCNARHRVTGFAYWGQGTQVTVSS

SEQ ID NO: 266 - protein, 114 aa, Artificial Sequence
  SR38_Vhh
EVQLVESGGGLVQPGGSLRLSCAVSQSISSINAMDWYRQAPGKQRELVAIIFNNGRTNYADSVKGRFTISRDNARNTVYLQMNSLKPEDTAVYYCNIVPPLRNWGQGTQVTVSS

SEQ ID NO: 267 - protein, 116 aa, Artificial Sequence
  SR42_Vhh
EVQLVESGGGLVRAGGSLRLSCAASGTISSYDVVGWYRQAPGKQRELVALIGTDRWLNLGDFAKGRFTMSTDDAANTVDLEMNSLKPEDTAVYYCYTFQHTVGPRWGQGTQVTVSS

SEQ ID NO: 268 - protein, 114 aa, Artificial Sequence
  SR47_Vhh
QLQLVESGGGLVQAGGSLKLSCVASGFTFSNYAMAWYRQAPGKQRELIASCSASCIWTNYGASVKGRFTMSLDNAKKTVYLQMDSLKPEDTAVYYCRNLDANYWGQGTQVTVSS

SEQ ID NO: 269 - protein, 114 aa, Artificial Sequence
  SR48_Vhh
EVQLVESGGGLVQAGGSLRLSCAASGFRIINDRMAWYRQAPGKQREAVASIDYAGSTTYAEFVKGRFTISRDNTKNMVTLQMNNLEPEDTAVYYCNTAPIARFRGQGTQVTVSS

SEQ ID NO: 270 - protein, 113 aa, Artificial Sequence
  SR52_Vhh
EVQVVESGGGLVQAGGSLRLSCAASTITISSAGVSWYRQAPGKQRELVAIITRGGSTNYADSVKGRFTISRDNAKNTHYLQMYNLKPEDTGIYYCNVVPPTYWGQGTQVTVSS

SEQ ID NO: 271 - protein, 114 aa, Artificial Sequence
  SR53_Vhh
QVQLVESGGGLVQAGGSLRLSCAASEGTLSSEAMGWHRLAPGKQRESVGFISSGGSTNYRDSVKGRFTISRDNAKNTVYLQMNSLKPEDTGVYFCRIPNSVGPWGQGTQVTVSS

SEQ ID NO: 272 - protein, 114 aa, Artificial Sequence
  SR55_Vhh
EVQVVESGGGLVQAGGSLRLSCVASGFDFSDSVMGWYRQAPGKQREAVAIISSVGQSNYRDSVQGRFTVSRSNTENTMYLQMDSLKPEDTAIYYCKKFGPGEYWGQGTQVTVSS

SEQ ID NO: 273 - protein, 127 aa, Artificial Sequence
  SR56_Vhh
EVQVVESGGGTVQAGGSLRLSCAASARTFANAHMAWFRQAPGKEREFLAAITWSGGITDYANSVKGRFTISRDNAENAMYLQMNSLKPEDTAIYICAVDTTSAYDQLWSRQSEYEYWGQGTQVTVSS

SEQ ID NO: 274 - protein, 131 aa, Artificial Sequence
  SR57_Vhh
QVQLVESGGGLVQPGGSLRLSCAASGFSLDAYAIGWFRQAPGMGREGVSCISSAGNTDYADSVKGRFAISRDNAKNTVYLQMNSLKPEDSGVYYCARTSEGVYRGRLACALYESAADFRSGGQGTRVTVSS

SEQ ID NO: 275 - protein, 122 aa, Artificial Sequence
  SR59_Vhh
QVQLVESGGFVQAGGSLRLSCAASGRTFSKYAMGWFRQAPGKEREFVAAIRWIGGSTYYADSVKGRFTISRDNDKNTLYLQMNSLKPEDTAVYYCAAGYQAYPEPPWEYDYWGQGTQVTVSS

SEQ ID NO: 276 - protein, 114 aa, Artificial Sequence
  SR60_Vhh
QVQLVESGGGLVQPGGSLRLSCVVSESISVINAMTWYRQAPGKQRELVALISRGGSTNYADSVKGRFTISRDNAKNSVYLQMNSLKPEDTALYYCNVVPPLGSWGQGTQVTVSS

SEQ ID NO: 277 - protein, 115 aa, Artificial Sequence
  SR61_Vhh
QLQLVESGGGLVRPGGSLRLSCAASGSIFSRSGATWYRQAPGKQRELVALLTRDGHTDYPVVSVKGRFTISKDNAKNTVYLQMNSLQPEDTAVYYCNAIPPLGSWGRGTQVTVSS

SEQ ID NO: 278 - protein, 113 aa, Artificial Sequence
  SR63_Vhh
EVQVVESGGGLVQPGGSLRLSCAASGSGFTINAMTWYRRAPGKERELVAIITNGGITNYADSVKGRFTISRDNAKSTVYLQMDGLEPEDTAVYYCNIVPPVYWGQGTQVTVSS

SEQ ID NO: 279 - protein, 125 aa, Artificial Sequence
  SR64_Vhh
QVQLVESGGGLVQAGGSLRLSCVASGRFPSIYRMAWFRQAPGKERDFVAAINWGGTATYYEDSVKGRFTISRDNTKNTVWLQMNSLKPEDTAVYYCAAGTGTTYTPQRGDAYGYWGQGTQVTVSS

SEQ ID NO: 280 - protein, 114 aa, Artificial Sequence
  SR67_Vhh
QLQLVESGGGLVQPGGSLRLSCAASRSISSINTMTWYRYQGPGKERELVALITLGGTTNYADSVKGRFTISRDDAKNTLYLEMNSLKPEDTAVYYCNAVPPFRWGQGTQVTVSS

SEQ ID NO: 281 - protein, 115 aa, Artificial Sequence
  SR68_Vhh
EVQVVESGGGLVQPGGSLRLSCVASGIIFSSYAMGWYRQAPGKQRELVARISSGGGLYYEDPVKGRFTISRDNARNTVYLQMSSVKPEDTAVYYCNVVPYTPGYWGQGTQVTVSS

SEQ ID NO: 282 - protein, 123 aa, Artificial Sequence
  SRHCC1_Vhh1
QLQLVESGGGLVQPGGSLRLSCAASGFTLDVYAIGWFRQAPGKEREGVSYITSGDGIFYADSVKGRFTISRDNAKNTVYLQMNSLKPEDTAVYFCATLKRTTAGGWPIPGRIGGQGTQVTVSS

SEQ ID NO: 283 - protein, 124 aa, Artificial Sequence
  SRHCC3_Vhh12
QVQLVESGGGLVQAGGSLRLSCAASGFTLENYAIGWFRQAPGKEREGVSYITGGTGTTVYADSVKGRFTISRDNTKNTVYLQMNSLKPEDTAVYFCATLKRTTAGGWPKPGRIGGQGTQVTVSS

SEQ ID NO: 284 - protein, 124 aa, Artificial Sequence
  SRHCC4_Vhh14
QLQLVESGGGLVQPGGSLRLSCAASGFTLDVYAIGWFRQAPGKEREGVSYITGGTGTTVYADSVKGRFTISRDNTKNTVYLQMNSLKPEDTAVYFCATLKRTTAGGWPKPGRIGGQGTQVTVSS

SEQ ID NO: 285 - protein, 124 aa, Artificial Sequence
  SRHCC5_Vhh-S1
QVQLVESGGGLVQAGGSLSLSCAASGRRFSTNVMGWFRQAPGKEREFLAAINWVIGNTNYAESVKGRFTISRDNAKETVYLQMDNLKVEDTAVYYCAGRSSYYTSSRREDYDYWGQGTQVTVSS

SEQ ID NO: 286 - protein, 120 aa, Artificial Sequence
  SRHCC6_Vhh-S8
QVQLVESGGGLVQLGGSLTLSCVASGDVHKINAKGWYRQAPGKEREVVAIITSGGTPYYADAVKGRFTISRHDDKNTVTLQMNSLKPEDTAMYYCAAGLRGMGPYDYDYRGPGTQVTVSS

SEQ ID NO: 287 - protein, 123 aa, Artificial Sequence
  SRHCC7_Vhh-S20
QVQLVESGGGLVQAGGSLKLSCAASGRSFSPYAMGWFRQAPGKDREFVAAISNSGGSTYYADAVKGRFSISRDNAKNTVYLQMNNLEPEDTAVYYCTGPVKRYSTDFQGGDYWGQGTQVTVSS

SEQ ID NO: 288 - protein, 122 aa, Artificial Sequence
  SRHCC8_Vhh-S28
QVQLVESGGGLVQPGGSLRLSCAASGSISTYTMAWYRQAPGEQRESVAAISSGGRTDYIDSVKGRFTISRDNAKNMVYLQMNSLKPEDTAVYYCNSADGLKIGTYYFKGLGWGQGTQVTVSA

SEQ ID NO: 289 - protein, 123 aa, Artificial Sequence
  SRHCC9_Vhh-S40
QVQLVESGGGLVQAGGSLRLSCAFSGRTFSKYAMAWFRQAPGKGRDFVARVGPSGRTTDYADSVKGRFTVSRDNAKNTVSLQMSSLKPDDAALYYCAATSGIYGESYNLYNYWGQGTQVTVSS

SEQ ID NO: 290 - protein, 123 aa, Artificial Sequence
  SRHCC10_Vhh-S56
QVQLVESGGGLVRPGGSLRVSCAASGVDISTYTMAWYRQAPGEQRESVAAISTTGRSIYIDAVQGRFTMSRDNAKNTVYLQMNNLKPEDTAVYYCNSADDLKIGTQYFKGLGWGQGTQVTVSS

SEQ ID NO: 291 - protein, 123 aa, Artificial Sequence
  SRHCC11_Vhh-S101
QVQLVESGGGLVQAGASLRLSCLGSGRSFGLRAMGWFRQAPGKELEFVAAIGKAGDTTYYTDSVKGRFTISRDNVKNAVYLQMNSLKPEDTAVYVCATAARWEPPTITPGSYRGPGTQVTVSS

SEQ ID NO: 292 - protein, 527 aa, Artificial Sequence
  SR18
METDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 293 - protein, 1149 aa, Artificial Sequence
  SR20
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 294 - protein, 1032 aa, Artificial Sequence
  SR21
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 295 - protein, 1166 aa, Artificial Sequence
  SR22
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 296 - protein, 1158 aa, Artificial Sequence
  SR23
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLESGVPSRFSGSGSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADDSKNTLYLQMNSLRAEDTAVYYCARWGGDGFYAMDVWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 297 - protein, 1149 aa, Artificial Sequence
  SR24
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 298 - protein, 1032 aa, Artificial Sequence
  SR25
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 299 - protein, 1166 aa, Artificial Sequence
  SR26
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDQVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGGGGSEVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 300 - protein, 1158 aa, Artificial Sequence
  SR27
MALPVTALLLPLALLLHAARPSPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMETDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 301 - protein, 510 aa, Artificial Sequence
  SR13
METDTLLLWVLLLWVPGSTGDDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 302 - protein, 519 aa, Artificial Sequence
  SR14
METDTLLLWVLLLWVPGSTGDDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 303 - protein, 8 aa, Artificial Sequence
  SRHCC4_Vhh14 CDR1 by IMGT
GFTLDVYA

SEQ ID NO: 304 - protein, 8 aa, Artificial Sequence
  SRHCC4_Vhh14 CDR2 by IMGT
ITGGTGTT

SEQ ID NO: 305 - protein, 12 aa, Artificial Sequence
  SRHCC4_Vhh14 CDR3 by IMGT
ATLKRTTAGGWP

SEQ ID NO: 306 - protein, 5 aa, Artificial Sequence
  SRHCC4_Vhh14 CDR1 by Kabat
VYAIG

SEQ ID NO: 307 - protein, 17 aa, Artificial Sequence
  SRHCC4_Vhh14 CDR2 by Kabat
YITGGTGTTVYADSVKG

SEQ ID NO: 308 - protein, 15 aa, Artificial Sequence
  SRHCC4_Vhh14 CDR3 by Kabat and Chothia
LKRTTAGGWPKPGRI

SEQ ID NO: 309 - protein, 7 aa, Artificial Sequence
  SRHCC4_Vhh14 CDR1 by Chothia
GFTLDVY

SEQ ID NO: 310 - protein, 6 aa, Artificial Sequence
  SRHCC4_Vhh14 CDR2 by Chothia
TGGTGT

SEQ ID NO: 311 - protein, 8 aa, Artificial Sequence
  SRHCC6_Vhh-S8 CDR1 by IMGT
GDVHKINA

SEQ ID NO: 312 - protein, 7 aa, Artificial Sequence
  SRHCC6_Vhh-S8 CDR2 by IMGT
ITSGGTP

SEQ ID NO: 313 - protein, 13 aa, Artificial Sequence
  SRHCC6_Vhh-S8 CDR3 by IMGT
AAGLRGMGPYDYD

SEQ ID NO: 314 - protein, 5 aa, Artificial Sequence
  SRHCC6_Vhh-S8 CDR1 by Kabat
INAKG

SEQ ID NO: 315 - protein, 16 aa, Artificial Sequence
  SRHCC6_Vhh-S8 CDR2 by Kabat
IITSGGTPYYADAVKG

SEQ ID NO: 316 - protein, 12 aa, Artificial Sequence
  SRHCC6_Vhh-S8 CDR3 by Kabat and Chothia
GLRGMGPYDYDY

SEQ ID NO: 317 - protein, 7 aa, Artificial Sequence
  SRHCC6_Vhh-S8 CDR1 by Chothia
GDVHKIN

SEQ ID NO: 318 - protein, 5 aa, Artificial Sequence
  SRHCC6_Vhh-S8 CDR2 by Chothia
TSGGT

SEQ ID NO: 319 - protein, 8 aa, Artificial Sequence
  SRHCC9_Vhh-S40 CDR1 by IMGT
GRTFSKYA

SEQ ID NO: 320 - protein, 8 aa, Artificial Sequence
  SRHCC9_Vhh-S40 CDR2 by IMGT
VGPSGRTT

SEQ ID NO: 321 - protein, 16 aa, Artificial Sequence
  SRHCC9_Vhh-S40 CDR3 by IMGT
AATSGIYGESYNLYNY

SEQ ID NO: 322 - protein, 5 aa, Artificial Sequence
  SRHCC9_Vhh-S40 CDR1 by Kabat
KYAMA

SEQ ID NO: 323 - protein, 17 aa, Artificial Sequence
  SRHCC9_Vhh-S40 CDR2 by Kabat
RVGPSGRTTDYADSVKG

SEQ ID NO: 324 - protein, 14 aa, Artificial Sequence
  SRHCC9_Vhh-S40 CDR3 by Kabat and Chothia
TSGIYGESYNLYNY

SEQ ID NO: 325 - protein, 7 aa, Artificial Sequence
  SRHCC9_Vhh-S40 CDR1 by Chothia
GRTFSKY

SEQ ID NO: 326 - protein, 6 aa, Artificial Sequence
  SRHCC9_Vhh-S40 CDR2 by Chothia
GPSGRT

What is claimed is:

1. A polynucleotide comprising a sequence encoding a polypeptide comprising the amino acid sequence set forth in any one of SEQ ID NOs: 35-38.

2. A vector comprising the polynucleotide of claim 1.

3. A fusion protein encoded by the polynucleotide of claim 1.

4. A host cell comprising the polynucleotide of claim 1.

5. The polynucleotide of claim 1, wherein the polynucleotide encodes a polypeptide comprising the amino acid sequence set forth in SEQ ID NO: 35.

6. The polynucleotide of claim 1, wherein the polynucleotide encodes a polypeptide comprising the amino acid sequence set forth in SEQ ID NO: 36.

7. The polynucleotide of claim 1, wherein the polynucleotide encodes a polypeptide comprising the amino acid sequence set forth in SEQ ID NO: 37.

8. The polynucleotide of claim 1, wherein the polynucleotide encodes a polypeptide comprising the amino acid sequence set forth in SEQ ID NO: 38.

9. A T lymphocyte comprising the polynucleotide of claim 1.

10. A composition comprising the T lymphocyte of claim 9.

11. A pharmaceutical composition comprising the composition of claim 10 and a pharmaceutically acceptable carrier.

* * * * *